(12) United States Patent
Vasquez et al.

(10) Patent No.: US 9,354,228 B2
(45) Date of Patent: May 31, 2016

(54) ANTIBODY LIBRARIES

(75) Inventors: Maximiliano Vasquez, Palo Alto, CA (US); Arvind Sivasubramanian, Santa Clara, CA (US); Michael Feldhaus, Grantham, NH (US)

(73) Assignee: Adimab, LLC, Lebanon, NH (US)

( * ) Notice: Subject to any disclaimer, the term of this patent is extended or adjusted under 35 U.S.C. 154(b) by 460 days.

(21) Appl. No.: 13/810,570

(22) PCT Filed: Jul. 14, 2011

(86) PCT No.: PCT/US2011/044063
§ 371 (c)(1),
(2), (4) Date: Apr. 1, 2013

(87) PCT Pub. No.: WO2012/009568
PCT Pub. Date: Jan. 19, 2012

(65) Prior Publication Data
US 2013/0197201 A1    Aug. 1, 2013

Related U.S. Application Data

(60) Provisional application No. 61/365,194, filed on Jul. 16, 2010.

(51) Int. Cl.
| | |
|---|---|
| *C40B 40/08* | (2006.01) |
| *G01N 33/543* | (2006.01) |
| *C07K 16/00* | (2006.01) |
| *C12N 15/10* | (2006.01) |
| *C40B 50/02* | (2006.01) |

(52) U.S. Cl.
CPC .............. *G01N 33/543* (2013.01); *C07K 16/00* (2013.01); *C12N 15/1089* (2013.01); *C07K 2317/21* (2013.01); *C07K 2317/565* (2013.01); *C07K 2317/567* (2013.01); *C40B 40/08* (2013.01); *C40B 50/02* (2013.01)

(58) Field of Classification Search
None
See application file for complete search history.

(56) References Cited

U.S. PATENT DOCUMENTS

| | | | |
|---|---|---|---|
| 4,946,778 | A | 8/1990 | Ladner et al. |
| 5,118,605 | A | 6/1992 | Urdea |
| 5,223,409 | A | 6/1993 | Ladner et al. |
| 5,283,173 | A | 2/1994 | Fields et al. |
| 5,380,833 | A | 1/1995 | Urdea |
| 5,525,490 | A | 6/1996 | Erickson et al. |

(Continued)

FOREIGN PATENT DOCUMENTS

| | | |
|---|---|---|
| DE | 19624562 A1 | 1/1998 |
| EP | 1438400 A1 | 7/2004 |

(Continued)

OTHER PUBLICATIONS

International Search Report and the Written Opinion of the International Searching Authority for PCT/US2011/044063, mailed Feb. 14, 2012.

(Continued)

*Primary Examiner* — Christian Boesen
(74) *Attorney, Agent, or Firm* — Brenda Herschbach Jarrell; Robert N. Sahr; Choate Hall & Stewart LLP

(57) ABSTRACT

The present invention overcomes the inadequacies inherent in the known methods for generating libraries of antibody-encoding polynucleotides by specifically designing the libraries with directed sequence and length diversity.

13 Claims, 15 Drawing Sheets

(56) References Cited

U.S. PATENT DOCUMENTS

| | | | |
|---|---|---|---|
| 5,530,101 A | 6/1996 | Queen et al. |
| 5,565,332 A | 10/1996 | Hoogenboom et al. |
| 5,571,698 A | 11/1996 | Ladner et al. |
| 5,618,920 A | 4/1997 | Robinson et al. |
| 5,658,727 A | 8/1997 | Barbas et al. |
| 5,688,666 A | 11/1997 | Bass et al. |
| 5,695,941 A | 12/1997 | Brent et al. |
| 5,723,323 A | 3/1998 | Kauffman et al. |
| 5,733,743 A | 3/1998 | Johnson et al. |
| 5,739,281 A | 4/1998 | Thogersen et al. |
| 5,750,373 A | 5/1998 | Garrard et al. |
| 5,767,260 A | 6/1998 | Whitlow et al. |
| 5,780,279 A | 7/1998 | Matthews et al. |
| 5,798,208 A | 8/1998 | Crea |
| 5,811,238 A | 9/1998 | Stemmer et al. |
| 5,814,476 A | 9/1998 | Kauffman et al. |
| 5,817,483 A | 10/1998 | Kauffman et al. |
| 5,821,047 A | 10/1998 | Garrard et al. |
| 5,824,514 A | 10/1998 | Kauffman et al. |
| 5,830,663 A | 11/1998 | Embleton et al. |
| 5,837,242 A | 11/1998 | Holliger et al. |
| 5,837,500 A | 11/1998 | Ladner et al. |
| 5,840,479 A | 11/1998 | Little et al. |
| 5,846,765 A | 12/1998 | Matthews et al. |
| 5,858,657 A | 1/1999 | Winter et al. |
| 5,858,671 A | 1/1999 | Jones |
| 5,863,765 A | 1/1999 | Berry et al. |
| 5,866,344 A | 2/1999 | Georgiou |
| 5,869,250 A | 2/1999 | Cheng et al. |
| 5,871,907 A | 2/1999 | Winter et al. |
| 5,872,215 A | 2/1999 | Osbourne et al. |
| 5,885,793 A | 3/1999 | Griffiths et al. |
| 5,888,773 A | 3/1999 | Jost et al. |
| 5,917,018 A | 6/1999 | Thogersen et al. |
| 5,922,545 A | 7/1999 | Mattheakis et al. |
| 5,928,868 A | 7/1999 | Liu et al. |
| 5,935,831 A | 8/1999 | Quax et al. |
| 5,948,620 A | 9/1999 | Hurd et al. |
| 5,955,275 A | 9/1999 | Kamb |
| 5,962,255 A | 10/1999 | Griffiths et al. |
| 5,965,368 A | 10/1999 | Vidal et al. |
| 5,969,108 A | 10/1999 | McCafferty et al. |
| 5,976,862 A | 11/1999 | Kauffman et al. |
| 5,994,515 A | 11/1999 | Hoxie |
| 5,994,519 A | 11/1999 | Osbourn et al. |
| 6,010,884 A | 1/2000 | Griffiths et al. |
| 6,017,732 A | 1/2000 | Jespers et al. |
| 6,027,910 A | 2/2000 | Klis et al. |
| 6,040,136 A | 3/2000 | Garrard et al. |
| 6,057,098 A | 5/2000 | Buechler et al. |
| 6,057,101 A | 5/2000 | Nandabalan et al. |
| 6,072,036 A | 6/2000 | Marasco et al. |
| 6,083,693 A | 7/2000 | Nandabalan et al. |
| 6,114,147 A | 9/2000 | Frenken et al. |
| 6,132,963 A | 10/2000 | Brent et al. |
| 6,140,471 A | 10/2000 | Johnson et al. |
| 6,159,705 A | 12/2000 | Trueheart et al. |
| 6,171,795 B1 | 1/2001 | Korman et al. |
| 6,172,197 B1 | 1/2001 | McCafferty et al. |
| 6,180,336 B1 | 1/2001 | Osbourn et al. |
| 6,187,535 B1 | 2/2001 | LeGrain et al. |
| 6,200,759 B1 | 3/2001 | Dove et al. |
| 6,225,447 B1 | 5/2001 | Winter et al. |
| 6,248,516 B1 | 6/2001 | Winter et al. |
| 6,291,158 B1 | 9/2001 | Winter et al. |
| 6,291,159 B1 | 9/2001 | Winter et al. |
| 6,291,160 B1 | 9/2001 | Lerner et al. |
| 6,291,161 B1 | 9/2001 | Lerner et al. |
| 6,291,650 B1 | 9/2001 | Winter et al. |
| 6,300,064 B1 | 10/2001 | Knappik et al. |
| 6,300,065 B1 | 10/2001 | Kieke et al. |
| 6,319,690 B1 | 11/2001 | Little et al. |
| 6,342,588 B1 | 1/2002 | Osbourn et al. |
| 6,358,733 B1 | 3/2002 | Motwani et al. |
| 6,406,863 B1 | 6/2002 | Zhu et al. |
| 6,410,246 B1 | 6/2002 | Zhu et al. |
| 6,410,271 B1 | 6/2002 | Zhu et al. |
| 6,420,113 B1 | 7/2002 | Buechler et al. |
| 6,423,538 B1 | 7/2002 | Wittrup et al. |
| 6,489,123 B2 | 12/2002 | Osbourn et al. |
| 6,492,107 B1 | 12/2002 | Kauffman et al. |
| 6,492,123 B1 | 12/2002 | Holliger et al. |
| 6,492,160 B1 | 12/2002 | Griffiths et al. |
| 6,521,404 B1 | 2/2003 | Griffiths et al. |
| 6,531,580 B1 | 3/2003 | Huse et al. |
| 6,544,731 B1 | 4/2003 | Griffiths et al. |
| 6,545,142 B1 | 4/2003 | Winter et al. |
| 6,555,313 B1 | 4/2003 | Griffiths et al. |
| 6,569,641 B1 | 5/2003 | Kauffman et al. |
| 6,582,915 B1 | 6/2003 | Griffiths et al. |
| 6,589,527 B1 | 7/2003 | Winter et al. |
| 6,589,741 B2 | 7/2003 | Pluckthun et al. |
| 6,593,081 B1 | 7/2003 | Griffiths et al. |
| 6,610,472 B1 | 8/2003 | Zhu et al. |
| 6,653,443 B2 | 11/2003 | Zhang et al. |
| 6,664,048 B1 | 12/2003 | Wanker et al. |
| 6,680,192 B1 | 1/2004 | Lerner et al. |
| 6,696,245 B2 | 2/2004 | Winter et al. |
| 6,696,248 B1 | 2/2004 | Knappik et al. |
| 6,696,251 B1 | 2/2004 | Wittrup et al. |
| 6,699,658 B1 | 3/2004 | Wittrup et al. |
| 6,706,484 B1 | 3/2004 | Knappik et al. |
| 6,753,136 B2 | 6/2004 | Lohning |
| 6,806,079 B1 | 10/2004 | McCafferty et al. |
| 6,828,422 B1 | 12/2004 | Achim et al. |
| 6,833,441 B2 | 12/2004 | Wang et al. |
| 6,846,634 B1 | 1/2005 | Tomlinson et al. |
| 6,916,605 B1 | 7/2005 | McCafferty et al. |
| 6,919,183 B2 | 7/2005 | Fandl et al. |
| 6,969,586 B1 | 11/2005 | Lerner et al. |
| 7,005,503 B2 | 2/2006 | Hua et al. |
| 7,063,943 B1 | 6/2006 | McCafferty et al. |
| 7,083,945 B1 | 8/2006 | Chen et al. |
| 7,094,571 B2 | 8/2006 | Harvey et al. |
| 7,138,496 B2 | 11/2006 | Hua et al. |
| 7,166,423 B1 | 1/2007 | Miltenyi et al. |
| 7,189,841 B2 | 3/2007 | Lerner et al. |
| 7,208,293 B2 | 4/2007 | Ladner et al. |
| 7,435,553 B2 | 10/2008 | Fandl et al. |
| 7,465,787 B2 | 12/2008 | Wittrup et al. |
| 7,569,357 B2 | 8/2009 | Kranz et al. |
| 2001/0037016 A1 | 11/2001 | Ning et al. |
| 2001/0041333 A1 | 11/2001 | Short et al. |
| 2002/0004215 A1 | 1/2002 | Osbourn et al. |
| 2002/0026653 A1 | 2/2002 | Allen et al. |
| 2002/0037280 A1 | 3/2002 | Lieber et al. |
| 2002/0169284 A1 | 11/2002 | Ashkenazi et al. |
| 2002/0197691 A1 | 12/2002 | Sugiyama |
| 2003/0022240 A1 | 1/2003 | Luo et al. |
| 2003/0091995 A1 | 5/2003 | Buechler et al. |
| 2003/0114659 A1 | 6/2003 | Winter et al. |
| 2003/0130496 A1 | 7/2003 | Winter et al. |
| 2003/0148372 A1 | 8/2003 | Tomlinson et al. |
| 2003/0165988 A1 | 9/2003 | Hua et al. |
| 2003/0190674 A1 | 10/2003 | Griffiths et al. |
| 2003/0228302 A1 | 12/2003 | Crea |
| 2003/0232333 A1 | 12/2003 | Ladner et al. |
| 2003/0232395 A1 | 12/2003 | Hufton |
| 2004/0038921 A1 | 2/2004 | Kreutzer et al. |
| 2004/0110941 A2 | 6/2004 | Winter et al. |
| 2004/0146976 A1 | 7/2004 | Wittrup et al. |
| 2004/0157214 A1 | 8/2004 | McCafferty et al. |
| 2004/0157215 A1 | 8/2004 | McCafferty et al. |
| 2004/0219611 A1 | 11/2004 | Racher |
| 2005/0202512 A1 | 9/2005 | Tomlinson et al. |
| 2006/0003334 A1 | 1/2006 | Achim et al. |
| 2006/0019260 A1 | 1/2006 | Lerner et al. |
| 2006/0166252 A1 | 7/2006 | Ladner et al. |
| 2006/0234302 A1 | 10/2006 | Hoet et al. |
| 2006/0257937 A1 | 11/2006 | Ladner |
| 2007/0031879 A1 | 2/2007 | Ley et al. |
| 2007/0099267 A1 | 5/2007 | Harvey et al. |
| 2007/0258954 A1 | 11/2007 | Iverson et al. |
| 2008/0108514 A1 | 5/2008 | Mattheus Hoogenboom |

(56) References Cited

U.S. PATENT DOCUMENTS

| | | |
|---|---|---|
| 2008/0153712 A1 | 6/2008 | Crea |
| 2008/0171059 A1 | 7/2008 | Howland et al. |
| 2009/0082213 A1 | 3/2009 | Horowitz et al. |
| 2009/0181855 A1 | 7/2009 | Vasquez et al. |
| 2010/0009866 A1 | 1/2010 | Prinz et al. |
| 2010/0056386 A1 | 3/2010 | Vasquez et al. |
| 2010/0292103 A1 | 11/2010 | Ladner |
| 2011/0009280 A1 | 1/2011 | Hufton et al. |
| 2011/0082054 A1 | 4/2011 | Ladner |
| 2011/0118147 A1 | 5/2011 | Ladner |
| 2011/0136695 A1 | 6/2011 | Crea |
| 2011/0172125 A1 | 7/2011 | Ladner |

FOREIGN PATENT DOCUMENTS

| | | |
|---|---|---|
| WO | WO-88/01649 A1 | 3/1988 |
| WO | WO-88/06630 A1 | 9/1988 |
| WO | WO-94/01567 A1 | 1/1994 |
| WO | WO-94/07922 A1 | 4/1994 |
| WO | WO-94/18330 A1 | 8/1994 |
| WO | WO-95/26400 A1 | 10/1995 |
| WO | WO-97/08320 A1 | 3/1997 |
| WO | WO-97/20923 A1 | 6/1997 |
| WO | WO-97/49809 A1 | 12/1997 |
| WO | WO-98/49198 A1 | 11/1998 |
| WO | WO-99/06834 A2 | 2/1999 |
| WO | WO-99/28502 A1 | 6/1999 |
| WO | WO-99/36569 A1 | 7/1999 |
| WO | WO-99/50461 A1 | 10/1999 |
| WO | WO-99/53049 A1 | 10/1999 |
| WO | WO-99/55367 A1 | 11/1999 |
| WO | WO-00/18905 A1 | 4/2000 |
| WO | WO-00/54057 A1 | 9/2000 |
| WO | WO-01/79229 A2 | 10/2001 |
| WO | WO-01/79481 A2 | 10/2001 |
| WO | WO-02/055718 A2 | 7/2002 |
| WO | WO-03/029456 A1 | 4/2003 |
| WO | WO-2005/007121 A2 | 1/2005 |
| WO | WO-2005023993 A2 | 3/2005 |
| WO | WO-2006/138700 A2 | 12/2006 |
| WO | WO-2007/056441 A2 | 5/2007 |
| WO | WO-2008/019366 A2 | 2/2008 |
| WO | WO-2008/053275 A2 | 5/2008 |
| WO | WO-2008067547 A2 | 6/2008 |
| WO | WO-2009/036379 A2 | 3/2009 |
| WO | WO-2010005863 A1 | 1/2010 |
| WO | WO-2010/105256 A1 | 9/2010 |
| WO | WO-2012/009568 A2 | 1/2012 |

OTHER PUBLICATIONS

International Preliminary Report of Patentability for PCT/US2011/044063, mailed Jan. 31, 2013.

Bahler et al., "Clonal Salivary Gland Infiltrates Assciated with Myoepithelial Sialadenitis (Sjogren's Syndrome) Begin as Nonmalignant Antigen-Selected Expansions", Blood, 91(6):1864-1872 (1998).

Bakkus et al., "Evidence that Multiple Myeloma Ig Heavy Chain VDJ Genes Contain Somatic Mutations but Show no Intraclonal Variation", Blood, 80(9):2326-2335 (1992).

Barbas et al., "Molecular Profile of an Antibody Response to HIV-1 as Probed by Combinatorial Libraries", J. Mol. Bioi., 230:812-823 (1993).

Carroll et al., "Absence of Ig V Region Gene Somatic Hypermutation in Advanced Burkitt's Lymphoma", J. Immunol.,143(2):692-698 (1989).

Davi et al., "High Frequency of Somatic Mutations in the VH Genes Expressed in Prolymphocytic Leukemia", Blood, 88(10):3953-3961 (1996).

DiPietro et al., "Limited number of immunoglobulin VH regions expressed in the mutant rabbit 'Alicia'", Eur. J. Immunol., 20:1401-1404 (1990).

Esposito et al., "Phage display of a human antibody against Clostridium tetani toxin", Gene, 148:167-168 (1994).

Huang et al., "A Majority of Ig H Chain eDNA of Normal Human Adult Blood Lymphocytes Resembles eDNA for Fetal Ig and Natural Autoantibodies", J. Immunol., 151:5290-5300 (1993).

Ivanovski et al., "Somatic Hypermutation, Clonal Diversity, and Preferential Expression of the VH 51p1/VL kv325 Immunoglobin Gene Combination in Hepatitis C Virus-Associated Immunocytomas", Blood, 91(7):2433-2442 (1998).

Lieber et al., "Lymphoid V(D)J recombination: Nucleotide insertion at signal joints as well as coding joints", Proc. Natl. Acad. Sci. USA, 85:8588-8592 (1988).

Lieber, M.R., "Site-specific recombination in the immune system", FASEB J., 5:2934-2944 (1991).

Liu et al., "Normal Human IgD+IgM- Germinal Center B Cells can Express up to 80 Mutations in the Variable Region of their IgD Transcripts", Immunity, 4:603-613 (1996).

Matolcsy et al., "Molecular Characterization of IgA- and/or IgG-Switched Chronic Lymphocytic Leukemia B Cells", Blood, 89(5):1732-1739 (1997).

Mcintosh et al., "Analysis of Immunoglobulin Gk Antithyroid Peroxidase Antibodies from Different Tissues in Hashimoto's Thyroiditis", J. Clin. Endocrinol. Metab., 82(11):3818-3825 (1997).

Mouquet et al., "Enhanced HIV-1 neutralization by antibody heteroligation", PNAS, published on line before printing, Jan. 4, 2012, doi:10.1073/pnas.1120059109.

Nissim et al., "Antibody fragments from a 'single pot' phage display library as immunochemical reagents", The EMBO Journal, 13(3):692-698 (1994).

Sahota et al., "Ig VH Gene Mutational Patterns Indicate Different Tumor Cell Status in Human Myeloma and Monoclonal Gammopathy of Undetermined Significance", Blood, 87(2):746-755 (1996).

Shimoda et al., "Natural polyreactive immunoglobulin A antibodies produced in mouse Peyer's patches", Immunology, 97:9-17 (1999).

Welschof et al., "Amino acid sequence based PCR primers for amplification of rearranced human heavy and light chain immunoglobulin variable region genes", J. Immunol. Meth., 179:203-214 (1995).

Wen et al., "T cells recognize the VH complementarity-determining region 3 of the idiotypic protein of B cell non-Hodgkin's lymphoma", Eur. J. Immunol., 27:1043-1047 (1997).

Winkler et al., "Analysis of immunoglobulin variable region genes from human IgG anti-DNA hybridomas", Eur. J. Immunol., 22:1719-1728 (1992).

Winter, Greg, "Synthetic human antibodies and a strategy for protein engineering", FEBS Letters, 430:92-94 (1998).

Zeng et al., "CD146, an epithelial-mesenchymal transition inducer, is associated with triple-negative breast cancer", published on line before print Dec. 30, 2011, doi:1010.1073/pnas.1111053108.

Abbas et al., "Cellular and Molecular Immunology", 4th ed., p. 43, Figure 3-1,. W.B. Saunders Co. (2000).

Abbas et al., Cellular and Molecular Immunology, Fourth Edition—Section III Maturation, Activation, and Regulation of Lymphocytes, 125-133 (2000).

Adams, G.P. and Schier, R., "Generating Improved Single-Chain Fv Molecules for Tumor Targeting" Journal of Immunological Methods, 231:249-260 (1999).

Adams, G.P. and Weiner, L. M., "Monoclonal antibody therapy of cancer" Nature Biotechnology, 23(9) 1147-1157 (2005).

Akamatsu, Y. et al., "Construction of a human Ig combinatorial library from genomic V segments and synthetic CDR3 fragments" J. Immunol., 51(9):4651-4659 (1993).

Allen, J.B. et al., "Finding prospective partners in the library: the two-hybrid system and phage display find a match" TIBS, 20:(12):511-516 (1995).

Alt, F.W. and Baltimore, D., "Joining of Immunoglobulin Heavy Chain Gene Segments: Implications from a Chromosome with Evidence of Three D-JH Fusions" PNAS, 79:4118-4122 (1982).

Arden, B., "Conserved motifs in T-cell receptor CDR1 and CDR2: implications for ligand and CDS co-receptor binding" Current Opinion in Immunology, Current Biology Ltd., 10(1):74- 81 (1998).

Aronheim, Ami et al., "Isolation of an AP-1 Repressor by a Novel Method for Detecting Protein-Protein Interactions" Molecular and Cellular Biology, 17(6):3094-3102 (1997).

(56) References Cited

OTHER PUBLICATIONS

Aujame, L. et al., "High affinity human antibodies by phage display" Human Antibodies, 8(4):155-168 (1997).
Ayala, M. et al., "Variable region sequence modulates periplasmic export of a single-chain Fv antibody fragment in *Escherichia coli*" BioTechniques, 18(5):832-838, 840-2 (1995).
Balint, R.F. and Larrick, J.W., "Antibody engineering by parsimonious mutagenesis" Gene, 137:109-118 (1993).
Barbas, C.F. 3rd et al., "Human autoantibody recognition of DNA" Proc. Natl. Acad. Sci., 92:2529-2533 (1995).
Barbas, C.F. 3rd et al., "Semisynthetic combinatorial antibody libraries: a chemical solution to the diversity problem" Proceedings of the National Academy of Sciences of USA, 89:4457-4461 (1992).
Barbas, C.F. 3rd, et al., "Assembly of combinatorial antibody libraries on phage surfaces: The gene III site" Proc. Natl. Acad. Sci., 88:7978-7982 (1991).
Basu, M. et al., "Synthesis of compositionally unique DNA by terminal deoxynucleotidyl transferase" Biochem. Biophys. Res. Comm., 111(3):1105-1112 (1983).
Bhatia, S.K. et al., "Rolling adhesion kinematics of yeast engineered to express selectins" Biotech. Prog., 19:1033-1037 (2003).
Binz, H.K. et al., "Engineering novel binding proteins from nonimmunoglobulin domains" Nat. Biotechnol., 23(10):1257-1268 (2005).
Bird, R.E. et al., "Single-chain antigen-binding proteins" Science, 242(4877):423-426 (1988).
Boder and Wittrup, "Yeast Surface Display for Directed Evolution of Protein Expression, Affinity, and Stability" Methods in Enzymology 328:430-444 (2000).
Boder and Wittrup, "Yeast surface display system for antibody engineeirng" pp. 283 (1996).
Boder et al., "Yeast Surface Display of a Noncovalent MHC Class II Heterodimer Complexed With Antigenic Peptide" Biotechnology and Bioengineering 92(4):485-491 (2005).
Boder, E.T. and Jiang, W., "Engineering Antibodies for Cancer Therapy" Annu. Rev. Chem. Biomol. Eng. 2:53-75 (2011).
Boder, E.T. and Wittrup, K.D., "Optimal screening of surface-displayed polypeptide libraries" Biotechnol Prog.,14(1):55-62 (1998).
Boder, E.T. and Wittrup, K.D., "Yeast surface display for screening combinatorial polypeptide libraries" Nat Biotechnol.,15(6):553-7 (1997).
Boder, E.T. et al., "Directed evolution of antibody fragments with monovalent femtomolar antigen-binding affinity" Proc Natl Acad Sci USA, 97(20):10701-5 (2000).
Borth, N. et al., "Efficient selection of high-producing subclones during gene amplification of recombinant Chinese hamster ovary cells by flow cytometry and cell sorting" Biotechnol. and Bioengin., 71(4):266-273 (2000-2001).
Bradbury, A., "Display Technologies Expand Their Horizons" TIBTECH 17:137-138 (1999).
Bradbury, A., "Molecular Library Technologies at the Millenium", TIBTECH 18:132-133 (2000).
Bradbury, A., "Recent advances in phage display: the report of the Phage Club first meeting" Immunotechnology, 3(3):227-231 (1997).
Breitling, F. et al., "A surface expression vector for antibody screening" Gene, 104(2):147-153 (1991).
Brezinschek, H.P. et al., "Analysis of the human VH gene repertoire. Differential effects of selection and somatic hypermutation on human peripheral CD5(+)/IgM+ and CD5(-)/IgM+ B cells" The American Society for Clinical Investigation, Inc., 99(10):2488-2501 (1997).
Broder, Y.C. et al., "The ras recruitment system, a novel approach to the study of protein-protein interactions" Current Biology 8(20):1121-1124 (1998).
Brophy et al., "A yeast display system for engineering functional peptide-MHC complexes" Journal of Immunological Methods 272:235-246 (2003).
Burke et al., "Methods in Yeast Genetics", pp. 40-41 (2000).
Burton, D.R. et al., "A large array of human monoclonal antibodies to type 1 human immunodeficiency virus from combinatorial libraries of asymptomatic seropostive individuals" Proc. Natl. Acad. Sci., 88(22):10134-10137 (1991).

Canaán-Haden, L., "Purification and application of a single-chain Fv antibody fragment specific to hepatitis B virus surface antigen" BioTechniques, 19(4) 606-608, 610, 612 passim(1995).
Cappellaro et al., "Mating type-specific cell—cell recognition of *Saccharomyces cerevisiae*: cell wall attachment and active sites of a- and ?-agglutinin1" The EMBO Journal 13(20)4737-4744 (1994).
Casset, F.et al., "A peptide mimetic of an anti-CD4 monoclonal antibody by rational design" Biochemical and Biophysical Research Communications, 307(1):198-205, (2003).
Castelli, L.A. et al., "High-level secretion of correctly processed beta-lactamase from *Saccharomyces ceravisiae* using a high-copy-number secretion vector" Biomolecular Research Institute, 142(1):113-117 (1994).
Caton, A.J. and Koprowski, H., "Influenza virus hemagglutinin-specific antibodies isolated from a combinatorial expression library are closely related to the immune response of the donor" Proc. Natl. Acad. Science, USA, 87(16):6450-6454 (1990).
Cattaneo, A. and Biocca, S., "The selection of intracellular antibodies" TIBTECH, 17:115-120 (1999).
Chang, C.N. et al., "Expression of antibody Fab domains on bacteriophage surfaces. Potential use for antibody selection" J. Immunol, 147(10):3610-3614. (1991).
Chang, H.C. et al., "A general method for facilitating heterodimeric pairing between two proteins: Application to expression of alpha and beta T-cell receptor extracellular segments" Proc Natl. Acad. Sci., USA, 91:11408-11412 (1994).
Chaudhary, V.K. et al., "A rapid method of cloning functional variable-region antibody genes in *Escherichia coli* as single-chain immunotoxins" Proc. Natl. Acad. Sci., 87(3):1066-1070 (1990).
Chen, W. et al., "Characterization of germline antibody libraries from human umbilical cord blood and selection of monoclonal antibodies to viral envelope glycoproteins: Implications for mechanisms of immune evasion and design of vaccine immunogens" Biochem. Biophys. Res. Commun. 1-6 (2012).
Chiswell, David and McCaffery, John, "Phage antibodies: will new 'coliclonal' antibodies replace monoclonal antibodies?" TIBTECH, 10(3):80-84 (1992).
Cho et al., "A yeast surface display system for the discovery of ligands that trigger cell activation" journal of Immunological Methods 220:179-188 (1998).
Chothia, C. and Lesk, A.M., "Canonical structures for the hypervariable regions of immunoglobulins" J. Mol. Biol., 196(4):901-917 (1987).
Chothia, C. et al., "Conformations of immunoglobulin hypervariable regions" Nature, 342(6252):877-883 (1989).
Chothia, C. et al., "Structural repertoire of the human VH segments" J. Mol. Biol., 227(3):799-817 (1992).
Cioe, L., Cloning and Nucleotide Sequence of a Mouse Erythrocyte beta-Spectrin cDNA, Blood, 70:915-920 (1987).
Clackson, T. and Wells, J.A., "In vitro selection from protein and peptide libraries" Trends Biotechnol., 12(5):173-184 (1994).
Clackson, T. et al., "Making antibody fragments using phage display librarires" Nature, 352(6336):624-628 (1991).
Co, M.S. and Queen, C., "Humanized antibodies for therapy" Nature, 351(6326):501-502 (1991).
Colby et al., "Development of a Human Light Chain Variable Domain (VL) Intracellular Antibody Specific for the Amino Terminus of Huntingtin via Yeast Surface Display" J. Mol. Biol. 901-912 (2004).
Collins, A.M. et al., "Partitioning of rearranged Ig genes by mutation analysis demonstrates D-D fusion and V gene replacement in the expressed human repertoire" J. Immunol., 172(1):340-348 (2004).
Collins, A.M. et al., "The reported germline repertoire of human immunoglobulin kappa chain genes is relatively complete and accurate" Immunogenetics, 60(11):669-676 (2008).
Corbett, S.J. et al., "Sequence of the human immunoglobulin diversity (D) segment locus: a systematic analysis provides no evidence for the use of DIR segments, nverted D egments, "minor" D segments or D-D recombination" J. Mol. Bioi., 270:587-597 (1997).
Courtney, B.C. et al., "A phage display vector with improved stability, applicability and ease of manipulation", Gene, 165(1):139-140 (1995).

(56) References Cited

OTHER PUBLICATIONS

Couto, J.R. et al., "Designing human consensus antibodies with minimal positional templates", Cancer Res., (23 Suppl):5973s-5977s (1995).
Crameri, R. and Suter, M., "Display of biologically active proteins on the surface of filamentous phages: a cDNA cloning system for selection of functional gene products linked to the genetic information responsible for their production" Gene, 137(1):69-75 (1993).
Cwirla, S.E., et al., "Peptides on phage: a vast library of peptides for identifying ligands" Proc. Natl. Acad. Sci. USA, 87(16):6378-6382 (1990).
Davies, J. and Riechmann, L., "Affinity improvement of single antibody VH domains: residues in all three hypervariable regions affect antigen binding" Immunotechnology 2(3):169-179 (1996).
de Haard et al., "A Large Non-immunized Human Fab Fragment Phage Library That Permits Rapid Isolation and Kinetic Analysis of High Affinity Antibodies" Journal of Biological Chemistry, 274(26):18218-18230 (1999).
De Jaeger, G. et al., "Analysis of the interaction between single-chain variable fragments and their antigen in a reducing intracellular environment using the two-hybrid system" FEBS Lett., 467(2-3):316-320 (2000).
de Kruif, J. et al., "Selection and application of human single chain Fv antibody fragments from a semi-synthetic phage antibody display library with designed CDR3 regions" J. Mol. Biol. 248(1):97-105 (1995).
Delves, P.J. "Antibody production: essential techniques" John Wiley & Sons, New York, pp. 90-113 (1997).
Dranginis et al., "A Biochemical Guide to Yeast Adhesins: Glycoproteins for Social and Antisocial Occasions" Microbiology and Molecular Biology Reviews 71(2)282-294 (2007).
Fan, Z. et al., "Three-dimensional structure of an Fv from a human IgM immunoglobulin" J. Mol. Biol., 228(1):188-207 (1992).
Fellouse, F.A. et al., "High-throughput Generation of Synthetic Antibodies from Highly Functional Minimalist Phage-displayed Libraries" J. Mol. Biol. 373(4):924-940 (2007).
Fellouse, F.A. et al., "Molecular Recognition by a Binary Code" J. Mol, Biol. 348(5):1153-1162 (2005).
Fellouse, F.A. et al., "Synthetic antibodies from a four-amino-acid code: a dominant role for tyrosine in antigen recognition" PNAS, 101(34):12467-12472 (2004).
Fields, S. and Sternglanz, R., "The two-hybrid system: an assay for protein-protein interactions" Trends Genet.,10(8):286-292 (1994).
Fields. S. and Song, O., "A novel genetic system to detect protein-protein interactions" Nature, 340(6230):245-246 (1989).
Firth, A.E. and Patrick, W.M., "Glue-It and Pedel-AA: new programmes for analyzing protein diversity in randomized libraries" Nucleic Acids Res., 36:W281-W285 (2008).
Frazer, J. K., and J. D. Capra, "Immunoglobulins: Structure and Function", in Fundamental Immunology, Fourth Edition, William E. Paul, ed., Lippincot-Raven Publishers, Philadelphia, pp. 41-43 and 51-52 (1999).
Frykman, S. and Srienc, F., "Quantitating secretion rates of individual cells: design of secretion assays" Biotechnol. & Bioeng., 59(2):214-226 (1998).
Fuh, G., "Synthetic antibodies as therapeutics" Expert Opin. Biol. Ther., 7(1):73-87 (2007).
Fusco, et al., In vivo construction of cDNA libraries for use in the yeast two-hybrid system. Yeast, 15(8):715-720 (1999).
Gietz et al., "Improved method for high efficiency transformation of intact yeast cells" Nucleic Acids Res., 20(6):1425 (1992).
Gietz, R.D. and R.H. Schiestl, "Transforming Yeast with DNA" Methods in Molecular and Cellular Biology (Invited Chapter), 5:255-269 (1995).
Gilfillan, S. et al., "Efficient immune responses in mice lacking N-region diversity" Eur. J. Immunol., 25(11):3115-3122 (1995).
Griffin et al., "Blockade of T Cell Activation Using a Surface-Linked Single-Chain Antibody to CTLA-4 (CD152)" J Immunol. 64(9):4433-4442 (2000).
Griffiths, A.D. et al., "Human anti-self antibodies with high specificity from phage display libraries" EMBO J., 12(2):725-734 (1993).
Griffiths, A.D. et al., "Isolation of high affinity human antibodies directly from large synthetic repertoires," EMBO J., 13(14):3245-3260 (1994).
Hamilton and Gerngross, "Glycosylation engineering in yeast: the advent of fully humanized yeast" Current Opinion in Biotechnology 18:387-392 (2007).
Hanes, J. et al., "Picomolar affinity antibodies from a fully synthetic naive library selected and evolved by ribosome display" Nat Biotechnol. 18:(12):1287-1292 (2000).
Hasan, N. and Szybalski, W., "Control of cloned gene expression by promoter inversion in vivo: construction of improved vectors with a multiple cloning site and the Ptac promoter" Gene, 56(1):145-151 (1987).
Hawkins, R.E. and Winter, G., "Cell selection strategies for making antibodies from variable gene libraries: trapping the memory pool" Eur. J. Immunol., 22(3):867-870 (1992).
He, M. and Taussig, M.J., "Antibody-ribosome-mRNA (ARM) complexes as efficient selection particles for in vitro display and evolution of antibody combining sites" Nucleic Acids Res., 25(24):5132-5134 (1997).
Hoet, R.M. et al., "Generation of high-affinity human antibodies by combining donor-derived and synthetic complementarity-determining-region diversity" Nat. Biotechnol., 23(3):344-348 (2005).
Hoet, R.M. et al., "The importance of the light chain for the epitope specificity of human anti-U1 small nuclear RNA autoantibodies present in systemic lupus erythematosus patients" Journal of Immunology,163(6):3304-3312 (1999).
Holler et al., "In vitro evolution of a T cell recepto with high affinity for peptide / MHC" Proc. Natl. Acad. Sci. 97(10):5387-5392 (2000).
Holmes, P. and Al-Rubeai, M., "Improved cell line development by a high throughput affinity capture surface display technique to select for high secretors" J. Immunol. Methods, 230(1-2):141-147 (1999).
Hoogenboom and Chames, "Natural and designer binding sites made by phage display technology" Immunology Today 21(8):371-378 (2000).
Hoogenboom, H.R. and Winter, G., "By-passing immunisation. Human antibodies from synthetic repertoires of germline VH gene segments rearranged in vitro" J. Mol. Biol., 227(2):381-388 (1992).
Hoogenboom, H.R. et al., "Antibody phage display technology and its applications" Immunotechnology, 4(1):1-20 (1998).
Hoogenboom, H.R. et al., "Multi-subunit proteins on the surface of filamentous phage: methodologies for displaying antibody (Fab) heavy and light chains" Nucleic Acids Research, 19(15):4133-4137 (1991).
Hoogenboom, H.R., "Designing and optimizing library selection strategies for generating high-affinity antibodies" Trends Biotechnol. 15(2):62-70 (1997).
Horwitz A.H. et al., "Secretion of functional antibody and Fab fragments from yeast cells" Proc. Natl. Acad. Sci. USA, 85(22):8678-8682 (1988).
Hoshino, Y. et al., "The rational design of a synthetic polymer nanoparticle that neutralizes a toxic peptide in vivo" PNAS 109(1):33-38 (2012).
Hua, S.B. et al., "Construction of a modular yeast two-hybrid cDNA library from human EST clones for the human genome protein linkage map" Gene, 215(1):143-152 (1998).
Hua, S.B. et al., "Minimum length sequence homology required for in vivo cloning by homologous recombination in yeast" Plasmid, 38(2):91-96 (1997).
Huang, D. and Shusta, E.V. et al., "Secretion and surface display of green fluorescent protein using the yeast *Saccharomyces cerevisiae*" Biotechnol. Prog., 21(2):349-357 (2005).
Hubberstey and Wildeman, "Use of interplasmid recombination to generate stable selectable markers for yeast transformation: application to studies of actin gene control" Genome 33(5):696-706 (1990).
Huse, W.D. et al., "Generation of a large combinatorial library of the immunoglobin repertoire in phage lambda" Science 246(4935):1275-1281 (1989).

(56) References Cited

OTHER PUBLICATIONS

Huston, J.S. et al., "Protein engineering of antibody binding sites: recovery of specific activity in an anti-digoxin single-chain Fv analogue produced in *Escherichia coli*" Proc. Natl. Acad. Sci. USA 85(16):5879-5883 (1988).
Imai and Yamamoto, "The fission yeast mating pheromone P-factor: its molecular structure, gene structure, and ability to induce gene expression and G1 arrest in the mating partner" Genes & Development 8:328-338 (1993).
Ivanov, I.I. et al., "Development of the expressed Ig CDR-H3 repertoire is marked by focusing of constraints in length, amino acid use, and charge that are first established in early B cell progenitors," J. Immunol., 174(12):7773-7780 (2005).
Jackson, K.J., et al., "Identifying highly mutated IGHD genes in the junctions of rearranged human immunoglobulin heavy chain genes," J. Immunol. Methods, 324(1-2):26-37 (2007).
Jirholt, P. et al., "Exploiting sequence space: shuffling in vivo formed complementarity determining regions into a master framework", Gene, 215(2):471-476 (1998).
Johns M. et al., "In vivo selection of sFv from phage display libraries" J. Immunol. Methods, 239(1-2):137-151 (2000).
Juul, L. et al., "The normally expressed kappa immunoglobulin light chain gene repertoire and somatic mutations studied by single-sided specific polymerase chain reaction (PCR); frequent occurrence of features often assigned to autoimmunity" Clin. Exp. Immunol., 109(1):194-203 (1997).
Kang, A.S. et al., "Linkage of recognition and replication functions by assembling combinatorial antibody Fab libraries along phage surfaces" Proc. Natl. Acad. Sci., 88(10):4363-4666 (1991).
Karu et al., "Recombinant Antibody Technology" ILAR Journal 37(3) pp. 1-9 (1995).
Kieke et al., "High Affinity T Cell Receptors from Yeast Display Libraries Block T Cell Activation by Superantigens" J. Mol. Biol. 307:1305-1315 (2001).
Kieke, M.C. et al., "Isolation of anti-T cell receptor scFv mutants by yeast surface display". Protein Eng. 10(11):1303-1310 (1997).
Kieke, M.C. et al., "Selection of functional T cell receptor mutants from a yeast surface-display library" Proc. Natl. Acad. Sci. USA, 96(10):5651-5656 (1999).
Klein, R. et al., "Expressed human immunoglobulin kappa genes and their hypermutation" Eur. J. Immunol., 23(12):3248-3262 (1993).
Knappik, A. et al., "Fully synthetic human combinatorial antibody libraries (HuCAL) based on modular consensus frameworks and CDRs randomized with trinucleotides" J. Mol. Biol., 296(1):57-86 (2000).
Koiwai, O. et al., "Isolation and characterization of bovine and mouse terminal deoxynucleotidyltransferase cDNAs expressible in mammalian cells" Nucleic Acids Res., 14(14):5777-5792 (1986).
Kokubu F. et al., Complete structure and organization of immunoglobulin heavy chain constant region genes in a phylogenetically primitive vertebrate, The EMBO Journal, 7(7):1979-1988 (1988).
Kontermann, R.E. and Müller, R., "Intracellular and cell surface displayed single-chain diabodies", J. Immunol. Methods, 226(1-2):179-188 (1999).
Kostrub, C.F. et al., "Use of gap repair in fission yeast to obtain novel alleles of specific genes" Nucleic Acids Research, 26(20):4783-4784 (1998).
Kranz and Voss, "Restricted reassociation of heavy and light chains from hapten-specific monoclonal antibodies" Proc. Natl. Acad. Sci. 78(9):5807-5811 (1981).
Kretzschmar, T. and von Rüden, T., "Antibody discovery: phage display" Curr. Opin. Biotechnol., 13(6):598-602 (2002).
Lake, D.F. et al., "Generation of diverse single-chain proteins using a universal (Gly4-Ser)3 encoding oligonucleotide" BioTechniques, 19(5):700-702 (1995).
Lee, C.E., et al., "Reconsidering the human immunoglobulin heavy-chain locus: 1. An evaluation of the expressed human IGHD gene repertoire" Immunogenetics, 57(12):917-925 (2006).
Lee, C.V. et al., "High-affinity human antibodies from phage-displayed synthetic Fab libraries with a single framework scaffold" J. Mol. Biol. 340(5):1073-1093 (2004).
Lee, S.Y. et al., "Microbial cell-surface display" Trends Biotechnol., 21(1):45-52 (2003).
Leonard, B. et al., "Co-expression of antibody fab heavy and light chain genes from separate evolved compatible replicons in *E. coli*" J. Immunol. Methods, 317(1-2):56-63 (2006).
Lerner, R.A. et al.,"Antibodies without immunization" Science,258(5086):1313-314 (1992).
Lewin, B., "Genes V", p. 99, Oxford University Press (1994).
Lin et al., "Display of a functional hetero-oligomeric catalytic antibody on the yeast cell surface" Appl. Microbiol. Biotechnol. 62:226-232 (2003).
Little, M. et al., "Generation of a large complex antibody library from multiple donors" J. Immunol Methods, 231(1-2):3-9 (1999).
Liu, Q. et al., "Rapid construction of recombinant DNA by the univector plasmid-fusion system" Methods Enzymol. 328:530-49 (2000).
Love J.C. et al., "A microengraving method for rapid selection of single cells producing antigen-specific antibodies" Nature Biotechnol. 24(6):703-707 (2006).
Lowman, H.B. et al., "Selecting high-affinity binding proteins by monovalent phage display" Biochemistry, 30(45):10832-10838 (1991).
Ma et al., "Association of Transport-Defective Light Chains with Immunoglobulin Heavy Chain Binding Protein" Molecular Immunology 27(7):623-630 (1990).
Ma, H. et al., "Plasmid construction by homologous recombination in yeast" Gene, 58(2-3):201-216 (1987).
MacCallum, R.M. et al., "Antibody-antigen interactions: contact analysis and binding site topography" J. Mol. Biol., 262(5):732-745 (1996).
Manivasakam and Schiestl, High efficiency transformation of *Saccharomyces cerevisiae* by electroporation Nucleic Acids Research 21(18)4414-4415 (1993).
Manz, R. et al., "Analysis and sorting of live cells according to secreted molecules, relocated to a cell-surface affinity matrix" Proc. Natl. Acad. Sci. USA, 92(6):1921-1925 (1995).
Marks, J.D. et al., "By-passing Immunization. Human Antibodies from V-gene Libraries Displayed on Phage" J. Mol. Biol., 222(3):581-597 (1991).
Marks, J.D. et al., "By-passing Immunization: building high affinity human antibodies by chain shuffling" Biotechnology (NY), 10(7):779-783 (1992).
Martin, A.C., "Accessing the Kabat antibody sequence database by computer" Proteins, 25(1):130-133 (1996).
Martin, A.C.and Thornton, J.M., "Structural families in loops of homologous proteins: automatic classification, modelling and application to antibodies" J. Mol. Biol., 263(5):800-815 (1996).
Matsuda, F. et al., "The complete nucleotide sequence of the human immunoglobulin heavy chain variable region locus" J. Exp. Med., 188(11):2151-2162 (1998).
Mattila, P.S. et al., "Extensive allelic sequence variation in the J region of the human immunoglobulin heavy chain gene locus" Eur. J. Immunol., 9(:)2578-2582 (1995).
Mazor Y. et al., "Isolation of engineered, full-length antibodies from libraries expressed in *Escherichia coli*" Nature Biotecnol., 25(5):563-565 (2007).
McCafferty, J. et al., "Phage antibodies: filamentous phage displaying antibody variable domains" Nature, 348(6301):552-554 (1990).
McCormack, W.T., Comparison of latent and nominal rabbit Ig VHa1 allotype cDNA sequences. J. Immunol., 141(6):2063-2071 (1988).
Mimran, A. et al., "GCN4-Based Expression System (pGES): Translationally Regulated Yeast Expression Vectors" BioTechniques, 28(3):552-554, 556, 558-560 (2000).
Mollova, S. et al., "Visualising the immune repertoire" BMC Systems Biology, 1(S1):P30 (2007).
Mullinax, R.L. et al., "Identification of human antibody fragment clones specific for tetanus toxoid in a bacteriophage lambda immunoexpression library" Proc. Natl. Acad. Sci., 87(20):8095-8099 (1990).

(56) References Cited

OTHER PUBLICATIONS

Mézard, C. et al., "Recombination between similar but not identical DNA sequences during yeast transformation occurs within short stretches of identity" Cell, 70(4):659-670 (1992).
Nakamura, Y. et al., "Development of novel whole-cell immunoadsorbents by yeast surface display of the IgG-binding domain" Appl. Microbiol. Biotechnol., 57(4):500-505 (2001).
Oldenburg, K.R et al., "Recombination-mediated PCR-directed plasmid construction in vivo in yeast" Nucleic Acids Res, 25(2):451-452 (1997).
Onda, T. et al., "A phage display system for detection of T cell receptor-antigen interactions" Mol Immunol., 32(17-18):1387-1397 (1995).
Orr et al., "Rapid Method for Measuring ScFv Thermal Stability by Yeast Surface Display" Biotechnol. Prog. 19:631-638 (2003).
Panka, D.J. et al., "Variable region framework differences result in decreased or increased affinity of variant anti-digoxin antibodies" Proc. Natl. Acad. Sci. USA, 85(9):3080-3084 (1988).
Parthasarathy, R. et al., "An immobilized biotin ligase: surface display of *Escherichia coli* BirA on *Saccharomyces cerevisiae*" Biotechnol. Prog., 21(6):1627-1631 (2005).
Pasqualini, R. and Ruoslahti, E., "Organ targeting in vivo using phage display peptide libraries" Nature, 380(6572):364-366 (1996).
Patel et al., "Parallel selection of antibody libraries on phage and yeast surfaces via a cross-species display" Protein Engineering, Design & Selection, pp. 1-9 (2011).
Patrick, W.M. et al., "User-friendly algorithms for estimating completeness and diversity in randomized protein-encoding libraries" Protein Engineering, 16(6):451-457 (2003).
Pearson, B.M. et al., "Construction of PCR-ligated long flanking homology cassettes for use in the functional analysis of six unknown open reading frames from the left and right arms of *Saccharomyces cerevisiae* chromosome XV" Yeast, 14(4):391-399 (1998).
Pepper et al., "A Decade of Yeast Surface Display Technology: Where Are We Now?" Combinatorial Chemistry & High Throughput Screening 11:127-134 (2008).
Persson, M.A. et al., "Generation of diverse high-affinity human monoclonal antibodies by repertoire cloning" Proc. Natl. Acad. Sci. USA, 88(6):2432-2436 (1991).
Philibert, P. et al., "A focused antibody library for selected scFvs expressed at high levels in the cytoplasm" BMC Biotechnol., 7:81 (2007).
Pini, A. et al., "Design and use of a phage display library. Human antibodies with subnanomolar affinity against a marker of angiogenesis eluted from a two-dimensional gel" Journal of Biological Chemistry, 273(34):21769-21776 (1998).
Pluckthun, A., "Antibody engineering: Advances from the use of *Escherichia coli* expression systems" Biotechnology (NY) 9(6):545-551 (1991).
Pogue and Goodnow, "Gene Dose-dependent Maturation and Receptor Editing of B Cells Expressing Immumoglobulin (Ig)G1 or IgM/IgG1 Tail Antigen Receptors" J. Exp. Med 191(6) 1031-1043 (2000).
Powell, Richard and McLane, Kathryn Evans, "Construction, assembly and selection of combinatorial antibody libraries." Genetic Engineering with PCR (Horton and Tait, Eds. 1998), vol. 5 of the Current Innovations in Molecular Biol series, Horizon Scientific Press, pp. 155-172.
Prabakaran, P. et al., "Expressed antibody repertoires in human cord blood cells: 454 sequencing and IMGT/High V-QUEST analysis of germline gene usage, junctional diversity, and somatic mutations" Immunogenetics (2011), pp. 1-14.
Prabakaran, P. et al., Supplemental "Expressed antibody repertoires in human cord blood cells: 454 sequencing and IMGT/High V-QUEST analysis of germline gene usage, junctional diversity, and somatic mutations" Immunogenetics (2011), pp. 1-6.
Proba, K. et al., "Antibody scFv fragments without disulfide bonds made by molecular evolution". J Mol Biol. 275(2):245-253 (1998).
Pörtner-Taliana, A. et al., "In vivo selection of single-chain antibodies using a yeast two-hybrid system", J. Immunol. Methods, 238(1-2):161-172 (2000).

Rader, C and Barbas, C.F. 3rd, "Phage display of combinatorial antibody libraries" Curr. Opin. Biotechnol., 8(4):503-508 (1997).
Rader, C. et al., "A phage display approach for rapid antibody humanization: designed combinatorial V gene libraries" Proc. Natl. Acad. Sci. USA, 95(15):8910-8915 (1998).
Rajan, S. And Sidhu, S., "Simplified Synthetic Antibody Libraries" Methods in Enzymology 202 3-23 (2012).
Rakestraw, J.A. and Wittrup, K.D., "Dissertation Abstracts International", 68(1B):43, abstract only (2006).
Rakestraw, J.A. et al., "A Flow Cytometric Assay for Screening Improved Heterologous Protein Secretion in Yeast." Biotechnol. Prog., 22(4):1200-1208 (2006).
Rauchenberger, R. et al., "Human combinatorial Fab library yielding specific and functional antibodies against the human fibroblast growth factor receptor 3" J. Biol. Chem., 278(40):38194-38205 (2003).
Raymond, C.K. et al., "General method for plasmid construction using homologous recombination" BioTechniques, 26(1):134-138, 140-141 (1999).
Retter, I. et al., "VBASE2, an integrative V gene database" Nucleic Acids Res., 33:D671-D674 (2005).
Rhoden, J.J. and Wittrup, K.D., "Dose Dependence of Intratumoral Perivascular Distribution of Monoclonal Antibodies" Journal of Pharmaceutical Sciences 101(2): 860-867 (2012).
Roitt, I. et al., "Immunoglobulins: A Family of Proteins", in Immunology, Sixth Edition, Mosby, Harcourt Publishers Limited, London, pp. 67-70 and 80 (2001).
Rudikoff, S. et al., "Single amino acid substitution altering antigen-binding specificity" Proc. Natl. Acad. Sci. USA, 79(6):1979-1983 (1982).
Ruiz, M. et al., "The human immunoglobulin heavy diversity (IGHD) and joining (IGHJ) segments." Exp. Clin. lrnrnunogenet, 16(3):173-184 (1999).
Ryu, D.D. and Nam, D.H., "Recent progress in biomolecular engineering" Biotechnol Prog, 16(1):2-16 (2000).
Saada, R. et al., "Models for antigen receptor gene rearrangement: CDR3 length" Immunol. Cell Biol., 85(4):323-332 (2007).
Sblattero, D. and Bradbury, A., "A definitive set of oligonucleotide primers for amplifying human V regions" Immunotechnology, 3(4):271-278 (1998).
Sblattero, D. and Bradbury, A., "Exploiting recombination in single bacteria to make large phage antibody libraries" Nat. Biotechnol., 18(1):75-80 (2000).
Scaviner, D. et al., "Protein displays of the human immunoglobulin heavy, kappa and lambda variable and joining regions." Exp. Clin. Immunogenet., 16(4):234-240 (1999).
Schable, K.F. and Zachau, H.G., "The variable genes of the human immunoglobulin kappa locus" Biol. Chem. Hoppe Seyler, 374(11):1001-1022 (1993).
Schoonbroodt, S. et al., "Oligonucleotide-assisted cleavage and ligation: a novel directional DNA cloning technology to capture cDNAs. Application in the construction of a human immune antibody phage-display library" Nucleic Acids Research, 33(9):e81:2-14 (2005).
Schreuder et al., "Immobilizing proteins on the surface of yeast cells" Trends Biotechnol. 14(4)115-120 (1996).
Schreuder et al., "Targeting of a Heterologous Protein to the Cell Wall of *Saccharamyces cerevisiae*" Yeast 9:399-409 (1993).
Schwager, J. et al., Amino acid sequence of heavy chain from Xenopus levis IgM deduced from cDNA sequence: Implications for evolution of immunoglobulin domains, Proc. Natl. Acad. Sci. USA, 85:2245-2249 (1988).
Seed, B., "Developments in expression cloning." Current Opinion in Biotechnology, 6(5):567-573 (1995).
Sharifmoghadam, et al., "The fission yeast Map4 protein is a novel adhesin required for mating" FEBS Letters 580:4457-4462 (2006).
Sheets, M.D. et al., "Efficient construction of a large nonimmune phage antibody library: The production of high-affinity human single-chain antibodies to protein antigens." Proc. Natl. Acad. Sci. USA, 95(11):6157-6162 (1998).
Shen et al., "Delineation of Functional Regions within the Subunits of the *Saccharomyces cerevisiae* Cell Adhesion Molecule a-Agglutinin" The Journal of Biological Chemistry 276(19):15768-15775 (2001).

(56) References Cited

OTHER PUBLICATIONS

Short, M.K. et al., "Contribution of antibody heavy chain CDR1 to digoxin binding analyzed by random mutagenesis of phage-displayed Fab 26-10" J. Biol. Chem., 270(48):28541-28550 (1995).
Shusta, E.V. et al., "Directed evolution of a stable scaffold for T-cell receptor engineering" Nat. Biotechnol.,18(7):754-759 (2000).
Shusta, E.V. et al., "Yeast Polypeptide Fusion Surface Display Levels Predict Thermal Stability and Soluble Secretion Efficiency" J. Mol. Biol. 292 949-956 (1999).
Sidhu, S.S, et al., "Phage-displayed antibody libraries of synthetic heavy chain complementarity determining regions" J. Mol. Biol. 338(2):229-310 (2004).
Skerra, A., "Alternative non-antibody scaffolds for molecular recognition" Current Opin. Biotechnol. 18(4):295-304 (2007).
Smith, G., "Homologous Recombination Near and Far from DNA Breaks: Alternative Roles and Contrasting Views" Annu Rev Genet 35:243-274 (2001).
Smith, G.P. and Petrenko, V.A., "Phage Display" Chern. Rev., 97(2):391-410 (1997).
Soderlind, E. et al., "Domain libraries: synthetic diversity for de novo design of antibody V-regions" Gene, 160(2): 269-272 (1995).
Soderlind, E. et al., "The immune diversity in a test tube—non-immunised antibody libraries and functional variability in defined protein scaffolds" Combinatorial Chemistry & High Throughput Screening, 4(5):409-416 (2001).
Souriau and Hudson, "Recombinant antibodies for cancer diagnosis and therapy" Expert Opin. Biol. Ther. 1(5):845-855 (2001).
Souto-Carneiro, M.M. et al., "Characterization of the Hurnan Ig Heavy Chain Antigen Binding Complementarity Determining Region 3 Using a Newly Developed Software Algorithm, JOINSOLVER," J. Immunol., 172(11):6790-6802 (2004).
Starwalt et al., "Directed evolution of a single-chain class II MHC product by yeast display" Protein Engineering 16(2):147-156 (2003).
Stewart, A.K. et al., "High-frequency representation of a single VH gene in the expressed human B cell repertoire" J. Exp. Med., 177(2):409-418 (1993).
Stohl, W. and Hilbert, D.M., "The discovery and development of belimumab: the anti-BLyS-lupus connection" Nature Biology 30(1):69-77 (2012).
Struhl et al., "High-frequency transformation of yeast: Autonomous replication of hybrid DNA molecules" Proc. Natl. Acad. Sci. 76(3):1035-1039 (1979).
Suzuki, M. et al., "Light chain determines the binding property of human anti-dsDNA IgG autoantibodies" Biochem. Biophys. Res. Commun., 271(1):240-243 (2000).
Swers et al., "Integrated Mimicry of B Cell Antibody Mutagenesis Using Yeast Homologous Recombination" Mol. Biotechnol. 46:57-69 (2011).
Swers, J.S. et al., "Shuffled antibody libraries created by in vivo homologous recombination and yeast surface display" Nuc. Acids. Res. 32(3), e36, 1-8 (2004).
Tavladoraki, P. et al., "Transgenic plants expressing a functional single-chain Fv antibody are specifically protected from virus attack" Nature, 366(6454):469-472 (1993).
Terskikh, A.V. et al., "Peptabody": A new type of high avidity binding protein Proc. Natl. Acad., 94(5):1663-1668 (1997).
Tomlinson, I.M. et al., "The repertoire of human germline VH sequences reveals about fifty groups of VH segments with different hypervariable loops" Journal of Molecular Biology, 227(3):776-798 (1992).
Tomlinson, I.M. et al., "The structural repertoire of the human V kappa domain" EMBO J., 14(18):4628-4638 (1995).
Tsurushita, N. et al., "Phage display vectors for in vivo recombination of immunoglobulin heavy and light chain genes to make large combinatorial libraries" Gene, 172(1):59-63 (1996).
Ueda and Tanaka, "Cell Surface Engineering of Yeast: Construction of Arming Yeast with Biocatalyst" Journal of Bioscience and Bioengineering 90(2):125:136 (2000).
Ueda, M. and Tanaka, A., "Genetic immobilization of proteins on the yeast cell surface" Biotechnology Advances, 18(2):121-140 (2000).
van den Beucken et al., "Affnity maturation of Fab antibody fragments by fluorescent-activated cell sorting of yeast-displayed libraries" FEBS Letters 546:288-294 (2003).
VanAntwerp and Wittrup, "Fine Affinity Discrimination by Yeast Surface Display and Flow Cytometry" Biotechnol. Prog. 16:31-37 (2000).
Vander Vaart, J.M. et al., "Comparison of cell wall proteins of *Saccharomyces cerevisiae* as anchors for cell surface expression of heterologous proteins" Appl. Environ. Microbiol., 63(2):615-620 (1997).
Vaswani, S.K. and Hamilton, R.G., "Humanized antibodies as potential therapeutic drugs" Ann. Allergy Athma Immunol., 81(2):105-115 (1998).
Vendel, M.C. et al., "Secretion from bacterial versus mammalian cells yields a recombinant scFv with variable folding properties" Arch. Biochem. Biophys. 1-6 (2012).
Visintin. M. et al., "Selection of antibodies for intracellular function using a two-hybrid in vivo system.", Proc. Natl. Acad. Sci. USA 96(21):11723-11728 (1999).
Volpe, J.M. and Kepler, T.B., "Genetic correlates of autoreactivity and autoreactive potential in human Ig heavy chains" Immunome Res., 5:1 (2009).
Volpe, J.M. et al., "SoDA: Implementation of a 3D Alignment Algorithm for Inference of Antigen Receptor Recombinations," Bioinformatics, 22(4):438-444 (2006).
Vugmeyster, Y. et al., "Complex Pharmacokinetics of a Humanized Antibody Against Human Amyloid Beta Peptide, Anti-Abeta Ab2, in Nonclinical Species" Pharm Res, 28:1696-1706 (2011).
Walhout, A.J. et al., "Gateway recombinational cloning: application to the cloning of large numbers of open reading frames or ORFeomes" Methods in Enzymology, 328:575-92 (2000).
Wang, Y. et al., "Many human immunoglobulin heavy-chain IGHV gene polymorphisms have been reported in error" Immunol. Cell. Biol., 86(2):111-115 (epub 2007-2008).
Weaver-Feldhaus, J.M. et al., "Yeast mating for combinatorial Fab library generation and surface display" FEBS Lett., 564(1-2):24-34 (2004).
Wentz, A.E. and Shusta, E.V., "A novel high-throughput screen reveals yeast genes that increase secretion of heterologous proteins" Appl. Environ. Microbiol., 73(4):1189-1198 (2007).
Winter G. and Milstein C., "Man-made antibodies" Nature, 349(6307):293-299 (1991).
Wood et al., "The synthesis and in vivo assembly of functional antibodies in yeast" Nature 314:(6010)446-449 (1985).
Woods and Gietz, "High-Efficiency Transformation of Plasmid DNA into Yeast", Methods in Molecular Biology, 177:85-97 (2001).
Wu, H. et al., "Humanization of a murine monoclonal antibody by simultaneous optimization of framework and CDR residues" J. Mol. Biol., 294(1):151-162 (1999).
Wörn, A. and Plückthun, A., "An intrinsically stable antibody scFv fragment can tolerate the loss of both disulfide bonds and fold correctly." FEBS Lett., 427(3):357-361 (1998).
Xu, J.L. and Davis, M.M., "Diversity in the CDR3 region of V(H) is sufficient for most antibody specificities" Immunity, 13(1):37-45 (2000).
Yang, W.P. et al., "CDR walking mutagenesis for the affinity maturation of a potent human anti-HIV-1 antibody into the picomolar range" J. Molecular Biology, 254(3):392-403 (1995).
Yeung and Wittrup, "Quantitative Screening of Yeast Surface-Displayed Polypeptide Libraries by Magnetic Bead Capture" Biotechnol. Prog. 18(2):212-220 (2002).
Zemlin, M. et al., "Expressed murine and human CDR-H3 intervals of equal length exhibit distinct repertoires that differ in their amino acid composition and predicted range of structures" J. Mol. Biol. 334(4):733-749 (2003).
Zucconi, A. et al., "Domain repertoires as a tool to derive protein recognition rules" FEBS Letters, 480(1):49-54 (2000).

FIGURE 4

| IGHJ3-02 | | ATGCTTTTGATATCT...TCTTCAG |
|---|---|---|
| IGHJ3-02-1 | Mutate 5' doublet | NNTGCTTTTGATATCT...TCTTCAG |
| IGHJ3-02-2 | Delete 5' codon | GCTTTTGATATCT...TCTTCAG |
| IGHJ3-02-3 | Mutate 5' doublet | NNTTTTGATATCT...TCTTCAG |
| IGHJ3-02-4 | Delete 5' codon | TTTGATATCT...TCTTCAG |
| IGHJ3-02-5 | Mutate 5' doublet | NNTGATATCT...TCTTCAG |

| IGHJ1-01 | | GCTGAATACTTCCAG...TCCTCAG |
|---|---|---|
| IGHJ1-01-1 | Mutate 5' doublet | NNTGAATACTTCCAG...TCCTCAG |
| IGHJ1-01-2 | Delete 5' codon | GAATACTTCCAG...TCCTCAG |
| IGHJ1-01-3 | Mutate 5' doublet | NNATACTTCCAG...TCCTCAG |
| IGHJ1-01-4 | Delete 5' codon | TACTTCCAG...TCCTCAG |
| IGHJ1-01-5 | Mutate 5' doublet | NNCTTCCAG...TCCTCAG |

| IGHJ2-01 | | CTACTGGTACTTCGA...TCCTCAG |
|---|---|---|
| IGHJ2-01-1 | Mutate 5' doublet | NNACTGGTACTTCGA...TCCTCAG |
| IGHJ2-01-2 | Delete 5' codon | CTGGTACTTCGA...TCCTCAG |
| IGHJ2-01-3 | Mutate 5' doublet | NNGGTACTTCGA...TCCTCAG |
| IGHJ2-01-4 | Delete 5' codon | GTACTTCGA...TCCTCAG |
| IGHJ2-01-5 | Mutate 5' doublet | NNACTTCGA...TCCTCAG |

FIGURE 8

Based on a set of CDRH3 sequences derived from 55 clinically relevant human mAbs

| Amino acid mismatches in Kabat-H3 region | LUA-141 | Exemplary Library Design 3 (EDLD-3) | Extended Diversity Library Design (EDLD) |
|---|---|---|---|
| 0 | 4 | 7 | 25 |
| 1 | 16 | 27 | 15 |
| 2 | 19 | 5 | 9 |
| 3-or-more | 16 | 16 | 6 |
| Total | 55 | 55 | 55 |

ANTIBODY LIBRARIES

RELATED APPLICATION

This application is a national phase entry under 35 U.S.C.§371 of International Application No. PCT/US2011/044063, filed Jul. 14, 2011, which claims priority to U.S. provisional application Ser. No. 61/365,194, filed on Jul 16, 2010, incorporated herein in their entirety by this reference.

SEQUENCE LISTING

In accordance with 37 CFR 1.52(e)(5), a Sequence Listing in the form of a text file (entitled "2009186-0093 ST25"created on Dec. 22, 2015, and 2,508,849 bytes in size) is incorporated by reference in its entirety.

BACKGROUND

Antibodies have profound relevance as research tools and in diagnostic and therapeutic applications. However, the identification of useful antibodies is difficult and once identified, antibodies often require considerable redesign or "humanization" before they are suitable for therapeutic applications in humans.

Many methods for identifying antibodies involve display of libraries of antibodies derived by amplification of nucleic acids from B cells or tissues. Some of these methods have utilized synthetic libraries. However, many of these approaches have limitations. For example, most human antibody libraries known in the art contain only the antibody sequence diversity that can be experimentally captured or cloned from a biological source (e.g., B cells). Accordingly, such libraries may over-represent some sequences, while completely lacking or under-representing other sequences, particularly those binding human antigens. Most synthetic libraries known in the art have other limitations, such as the occurrence of unnatural (i.e., non-human) amino acid sequence motifs that have the potential to be immunogenic.

Accordingly, a need exists for diverse antibody libraries that contain candidate antibodies that are non-immunogenic (i.e., are human) and have desired properties (e.g., the ability to recognize a broad variety of antigens). However, obtaining such libraries requires balancing the competing objectives of generating diverse libraries while still maintaining the human character of the sequences within the library. The current invention provides antibody libraries that have these and other desirable features, and methods of making and using such libraries.

SUMMARY

The invention provides, among other things, improvements in the design and production of synthetic libraries that mimic the diversity of the natural human repertoire of CDRH3, CDRL3, heavy chain, light chain, and/or full-length (intact) antibody sequences. In some embodiments the invention defines and provides methods of generating theoretical segment pools of TN1, DH, N2, and H3-JH segments to consider for inclusion in a physical manifestation of a library (e.g., polynucleotide or polypeptide) comprising or encoding CDRH3 sequences (e.g., an antibody library). In certain embodiments the invention defines and provides methods of matching the individual members of these theoretical segment pools to a reference set of CDRH3 sequences, to determine the frequency of occurrence (or segment usage weight) of each of the segments in the theoretical segment pool in the reference set. While any set of CDRH3 sequences may be used as a reference set, the invention also defines and provides methods of generating particular reference sets or subsets of interest. For example, among other things, the present invention provides methods for filtering an original reference set to obtain a provided reference set with a preimmune character. Also provided are methods to define and/or identify segments that occur within the CDRH3 sequences in the reference set but not in the theoretical segment pool. Such segments can be added to a theoretical segment pool, for example in order to be considered for inclusion in a physical library. Although the frequency of occurrence of a particular segment in a reference set is useful to select segments for inclusion in a physical library, the invention also provides a number of physicochemical and biological properties that can be used (alone or together with any other criterion or criteria) to select segments for inclusion in a physical library.

In some embodiments the invention provides libraries that differ from certain other libraries known in the art in that they are not sitewise-stochastic in composition or sequence, and are therefore intrinsically less random than these certain other libraries of the art (see e.g., Example 14 of US Pub. No. 2009/0181855, incorporated by reference in its entirety, for a discussion of information content and randomness). In some embodiments, degenerate oligonucleotides may be used to further increase the diversity of the members of a library while further improving matching with a reference set of sequences (e.g., CDRH3, CDRL3, heavy chain, light chain, and/or full-length (intact) antibody sequences).

The invention also provides libraries whose members have sequences that are related to one another in that they would be selected for inclusion in a physical library by performing the analyses described herein, for example by generating a CDRH3 reference set as in Example 3; generating theoretical segment pools as in Examples 5-7; matching the members of a theoretical segment pool to the reference set as in Examples 4 and 8; and selecting members of the theoretical segment pool for inclusion in a physical library as in Examples 8-9. Also provided are methods of further increasing diversity in certain sequences by utilizing degenerate oligonucleotides as in Examples 12-16.

In some embodiments, the present invention provides polynucleotide and polypeptide libraries comprising CDRH3, CDRL3, heavy chain, light chain, and/or full-length (intact) antibody sequences, and methods of making and using such libraries.

In some embodiments, the invention provides libraries comprising, consisting essentially of, or consisting of any of the libraries or theoretical segment pools described herein.

In some embodiments, the present invention recognizes that by mimicking the in vivo activity of the enzyme TdT computationally, theoretical segment pools can be generated and subsequently matched to large reference datasets of CDR sequences to choose, for inclusion in a library, those theoretical segments that best recapitulate the CDR sequences in the reference data sets.

In certain embodiments, the invention provides libraries of polynucleotides comprising at least about $10^4$ polynucleotides encoding CDRH3 polypeptides with the structure: [TN1]-[DH]-[N2]-[H3-JH], wherein: TN1 is a polypeptide corresponding to any of the TN1 polypeptides of Tables 9-10 and 18-26, or a polypeptide produced by translation of any of the TN1 polynucleotides of Tables 25-26; DH is a polypeptide corresponding to any of the DH polypeptides of Tables 9, 11, 17-25 and 28, or a polypeptide produced by translation of any of the DH-encoding polynucleotides of Tables 16, 25 and 27; N2 is a polypeptide corresponding to any of the N2 polypeptides of Tables 9, 12, 18-25 and 30, or a polypeptide produced by translation of any of the N2-encoding polynucleotides of Tables 25 and 29; and H3-JH is a polypeptide corresponding to any of the H3-JH polypeptides of Tables 9, 13, 15, 18-25 and 32, or a polypeptide produced by translation of any of the H3-JH-encoding polynucleotides of Tables 14, 25 and 31.

In some embodiments, the invention provides libraries wherein at least about 1%, 5%, or 10% of the sequences in the library have the structure provided above, or that of any of the libraries provided herein.

In certain embodiments, the invention provides libraries comprising polynucleotides encoding CDRH3 polypeptides produced by the sets of TN1, DH, N2, and H3-JH polypeptides provided in any one of Tables 23-25.

In some embodiments, the invention provides libraries comprising polynucleotides encoding CDRH3 polypeptides produced by the set of TN1 polypeptides provided in Table 26, the set of DH polypeptides provided in Table 28, the set of N2 polypeptides provided in Table 30 and the set of H3-JH polypeptides provided in Table 32.

In certain embodiments, the invention provides libraries whose members show (or encode polypeptides that show) at least a certain percent identity with the polypeptides described above, for example, a library comprising at least about $10^4$ polynucleotides encoding CDRH3 polypeptides with the structure: [TN1]-[DH]-[N2]-[H3-JH], wherein: TN1 is a polypeptide at least about 80%, 90%, or 95% identical to any of the TN1 polypeptides of Tables 9-10 and 18-26, or a polypeptide at least about 80%, 90%, or 95% identical to a polypeptide produced by translation of any of the TN1 polynucleotides of Tables 25-26; DH is a polypeptide at least about 80%, 90%, or 95% identical to any of the DH polypeptides of Tables 9, 11, 17-25 and 28, or a polypeptide at least about 80%, 90%, or 95% identical to a polypeptide produced by translation of any of the DH-encoding polynucleotides of Tables 16, 25 and 27; N2 is a polypeptide at least about 80%, 90%, or 95% identical to any of the N2 polypeptides of Tables 9, 12, 18-25 and 30, or a polypeptide at least about 80%, 90%, or 95% identical to a polypeptide produced by translation of any of the N2-encoding polynucleotides of Tables 25 and 29; and H3-JH is a polypeptide at least about 80%, 90%, or 95% identical to any of the H3-JH polypeptides of Tables 9, 13, 15, 18-25 and 32, or a polypeptide at least about 80%, 90%, or 95% identical to a polypeptide produced by translation of any of the H3-JH-encoding polynucleotides of Tables 14, 25 and 31.

In some embodiments, the invention provides libraries comprising polynucleotides encoding light chain variable regions, wherein the light chain variable regions are selected from the group consisting of: (a) a VK1-05 sequence varied at one or more of positions 4, 49, and 46; (b) a VK1-12 sequence varied at one or more of positions 4, 49, 46, and 66; (c) a VK1-33 sequence varied at one or more of positions 4, 49, and 66; (d) a VK1-39 sequence varied at one or more of positions 4, 49, and 46; (e) a VK2-28 sequence varied at one or more of positions 2, 4, 46, and 49; (f) a VK3-11 sequence varied at one or more of positions 2, 4, 36, and 49; (g) a VK3-15 sequence varied at one or more of positions 2, 4, 48, and 49; (h) a VK3-20 sequence varied at one or more of positions 2, 4, 48, and 49; and/or (i) a VK4-1 sequence varied at one or more of positions 4, 46, 49, and 66.

In certain embodiments, the invention provides libraries comprising polynucleotides encoding light chain variable regions that comprise polypeptide sequences at least about 80%, 90%, or 95% identical to two or more of the light chain polypeptide sequences provided in Table 3.

In some embodiments, the invention provides libraries wherein the light chain variable regions comprise the polypeptide sequences provided in Table 3.

In certain embodiments, the invention provides libraries comprising polynucleotides encoding light chain variable regions, wherein the L3-VL polypeptide sequences of the light chain variable regions are varied at two or three residues between positions 89 to 94, inclusive, in comparison to an L3-VL germline sequence. In some embodiments, libraries containing a single light chain germline sequence and its variants are provided. In certain embodiments, variants produced from different light chain germline sequences can be combined to produce libraries encoding multiple light chain germline sequences and their variants. Any of the light chain L3-VL germline sequences provided herein may be varied at two or three residues between positions 89 to 94, inclusive, and one of ordinary skill in the art will recognize that any other L3-VL sequence can also be varied according to the principles described herein to produce libraries provided by the invention. In some embodiments, the present invention comprises libraries containing polynucleotides that encode antibody light chain variable regions, wherein the antibody light chain variable regions comprise one or more of the following L3-VL sequences: (i) an amino acid sequence that is identical to an L3-VL germline sequence (e.g., see Table 1); (ii) an amino acid sequence that contains two substitutions between residues 89-94, inclusive, in comparison to an L3-VL germline sequence; and (iii) an amino acid sequence that contains three substitutions between residues 89-94, inclusive, in comparison to an L3-VL germline sequence. In some embodiments, each antibody light chain variable region on a library includes one or more of the above L3-VL sequences. In some embodiments, such a library is combined with one or more sets of other nucleic acids that may or may not encode antibody light chain variable regions, and may or may not contain such L3-VL sequences. In some embodiments, the present invention comprises libraries containing polynucleotides that encode an antibody light chain variable region having an amino acid sequence as set forth in Table 4, or a polynucleotide sequence as set forth in one or more of Tables 5-7, wherein two or three residues at positions 89-94, inclusive, are varied.

In some embodiments, the present invention comprises libraries containing polynucleotides that encode an antibody light chain variable region, wherein, across the library, all encoded antibody light chain variable regions are identical to one another except for substitutions of residues at positions between residue 89 and residue 94, inclusive and further wherein, across the library, sequences of any two encoded antibody light chain variable regions differ from one another at not more than 3 positions.

In some embodiments, the invention provides libraries comprising polynucleotides encoding light chain variable regions comprising polypeptide sequences at least about 80%, 90%, or 95% identical to polypeptides produced by translation of two or more of the polynucleotide sequences provided in Tables 5-7. In certain embodiments all members of the library are at least about 80%, 90%, or 95% identical to polypeptides produced by translation of two or more of the polynucleotide sequences provided in Tables 5-7.

In certain embodiments, the invention provides a library comprising light chain variable regions that comprise the polypeptides produced by translation of the polynucleotide sequences provided in Tables 5-7. In certain embodiments, all members of the library comprise the polypeptides produced by translation of the polynucleotide sequences provided in Tables 5-7.

In some embodiments, any of the libraries described herein as containing or encoding CDRL3 and/or light chain variable regions, contains or encodes such CDRL3 and/or light chain variable regions in the context of complete light chains. Furthermore, in some embodiments, such libraries (and/or complete light chain libraries) further contain or encode one or more heavy chain CDRH3, variable domains, or intact heavy chains. In some embodiments, provided libraries include or encode intact antibodies such as, for example, intact IgGs.

In some embodiments, provided libraries include or encode human antibodies or antibody fragments; in some such embodiments, provided libraries include or encode intact human antibodies.

In certain embodiments, the invention provides libraries that comprise nucleic acid vectors containing library nucleic acids described herein. In many embodiments, each such library member comprises the same vector.

In some embodiments, the invention provides host cells containing one or more provided libraries, for example including a vector. In some embodiments the host cell is a yeast, and in certain embodiments the yeast is *Saccharomyces cerevisiae*.

In some embodiments, the invention provides antibodies isolated from the libraries described herein.

In certain embodiments, the invention provides kits containing any of the libraries described herein.

In some embodiments, the invention provides representations of libraries and/or theoretical segment pools in a computer readable format, for example, the TN1 polypeptides of Tables 10, 23-25 and 26; the DH polypeptides of Tables 11, 23-25 and 28; the N2 polypeptides of Tables 12, 23-25 and 30; the H3-JH polypeptides of Tables 13, 15, 17, 23-25 and 32; the TN1 polynucleotides of Tables 25-26; the DH polynucleotides of Tables 25 and 27; the N2 polynucleotides of Tables 25 and 29; and/or the H3-JH polynucleotides of Tables 25 and 31.

In certain embodiments, the invention provides a representation of the polynucleotide sequences of the Human Preimmune Set (Appendix A), or the polypeptide expression products thereof, in a computer readable format.

In some embodiments, the invention provides a method of making synthetic polynucleotides encoding a CDRH3 library, comprising: (a) providing a theoretical segment pool containing TN1, DH, N2, and H3-JH segments; (b) providing a reference set of CDRH3 sequences; (c) utilizing the theoretical segment pool of (a) to identify the closest match(es) to each CDRH3 sequence in the reference set of (b); (d) selecting segments from the theoretical segment pool for inclusion in a synthetic library; and (e) synthesizing the synthetic CDRH3 library. In certain embodiments, the invention provides libraries made by this method. In some embodiments, the segments selected for inclusion in the synthetic library are selected according to their segment usage weight in the reference set of CDRH3 sequences.

In certain embodiments, the invention provides a method of making synthetic polynucleotides encoding a CDRL3 library, comprising: (i) obtaining a reference set of light chain sequences, wherein the reference set contains light chain sequences with VL segments originating from the same IGVL germline gene and/or its allelic variants; (ii) determining which amino acids occur at each of the CDRL3 positions in the reference set that are encoded by the IGVL gene; (iii) synthesizing light chain variable domain encoding sequences wherein two positions between positions 89 and 94, inclusive, contain degenerate codons encoding two or more of the five most frequently occurring amino acid residues at the corresponding positions in the reference set; and (iv) synthesizing the polynucleotides encoding the CDRL3 library. In certain embodiments, the invention provides libraries made by this method.

In some embodiments, the invention provides a method of using any of the libraries of the invention to isolate an antibody binding an antigen, comprising contacting the polypeptide expression products of said libraries with an antigen and isolating polypeptide expression products that bind to the antigen.

In certain embodiments, the number of N-linked glycosylation sites, deamidation motifs, and/or Cys residues in the libraries of the invention are reduced or eliminated in comparison to libraries produced by amplification of a repertoire from a biological source.

The invention provides a number of polynucleotide and polypeptide sequences and segments that can be used to build larger polynucleotide and polypeptide sequences (e.g., TN1, DH, N2, and H3-JH segments that can be used to build CDRH3). One of ordinary skill in the art will readily recognize that in some instances these sequences can be more succinctly represented by providing consensus sequences after alignment of the sequences provided by the invention, and that these consensus sequences fall within the scope of the invention and may be used to more succinctly represent any of the sequences provided herein.

BRIEF DESCRIPTION OF THE DRAWING

FIG. 4 shows the application of a provided method used to generate nucleotide sequences (SEQ ID NOS 8748-8759, respectively, in order of appearance) encoding the parent H3-JH segments.

FIG. 8 shows that Exemplary Library Design 3 (ELD-3) and the Extended Diversity Library Design both return better matches to clinically relevant CDRH3 sequences than the LUA-141 library.

DETAILED DESCRIPTION OF CERTAIN EMBODIMENTS OF THE INVENTION

Figure 1:
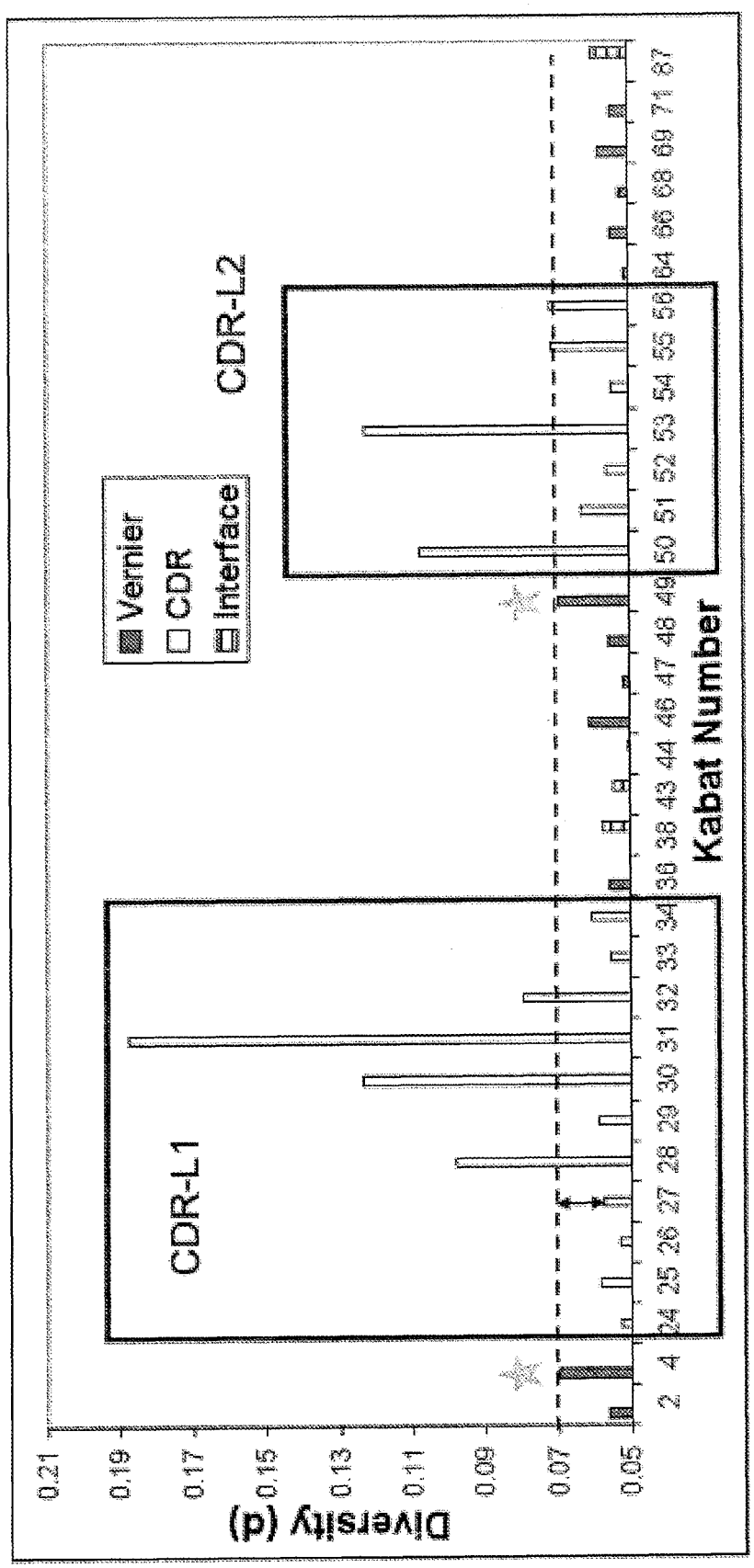
FIG. 1 shows that Vernier residues 4 and 49 (starred) in VK1-39 have a diversity index comparable to or greater than the diversity indices of the CDR positions (i.e., at or above 0.07, in this example).

The present invention provides, among other things, polynucleotide and polypeptide libraries, methods of producing and using the libraries, kits containing the libraries, and computer readable forms of representations of libraries and/or theoretical segment pools disclosed herein. Libraries taught in this application can be described, at least in part, in terms of components (e.g., polynucleotide or polypeptide "segments") from which they are assembled. Among other things, the present invention specifically provides and contemplates these polynucleotide or polypeptide segments, methods of producing and using such segments, and kits and computer readable forms of representations that include such library segments.

In certain embodiments, the invention provides antibody libraries specifically designed based on sequences and CDR length distribution in a naturally occurring human antibody repertoire. It is estimated that, even in the absence of antigenic stimulation, an individual human makes at least about $10^7$ different antibody molecules (Boyd et al., Science Translational Medicine, 2009, 1: 1). The antigen-binding sites of many antibodies can cross-react with a variety of related but different epitopes. In addition, the human antibody repertoire is large enough to ensure that there is an antigen-binding site to fit almost any potential epitope, albeit potentially with low affinity.

The mammalian immune system has evolved unique genetic mechanisms that enable it to generate an almost unlimited number of different light and heavy chains in a remarkably economical way, by combinatorially joining chromosomally separated gene segments prior to transcription. Each type of immunoglobulin (Ig) chain (i.e., kappa light, lambda light, and heavy) is synthesized by combinatorial assembly of DNA sequences, selected from two or more families of gene segments, to produce a single polypeptide chain. Specifically, the heavy chains and light chains each consist of a variable region and a constant (C) region. The variable regions of the heavy chains are encoded by DNA sequences assembled from three families of gene sequences: variable (IGHV), diversity (IGHD), and joining (IGHJ). The variable regions of light chains are encoded by DNA sequences assembled from two families of gene sequences for each of the kappa and lambda light chains: variable (IGLV) and joining (IGLJ). Each variable region (heavy and light) is also recombined with a constant region, to produce a full-length immunoglobulin chain.

While combinatorial assembly of the V, D and J gene segments make a substantial contribution to antibody variable region diversity, further diversity is introduced in vivo, at the pre-B cell stage, via imprecise joining of these gene segments and the introduction of non-templated nucleotides at the junctions between the gene segments (see e.g., U.S. Pub. No. 2009/0181855, which is incorporated by reference in its entirety, for more information).

After a B cell recognizes an antigen, it is induced to proliferate. During proliferation, the B cell receptor locus undergoes an extremely high rate of somatic mutation that is far greater than the normal rate of genomic mutation. The mutations that occur are primarily localized to the Ig variable regions and comprise substitutions, insertions and deletions. This somatic hypermutation enables the production of B cells that express antibodies possessing enhanced affinity toward an antigen. Such antigen-driven somatic hypermutation fine-tunes antibody responses to a given antigen.

Synthetic antibody libraries of the instant invention have the potential to recognize any antigen, including antigens of human origin. The ability to recognize antigens of human origin may not be present in other antibody libraries, such as antibody libraries prepared from human biological sources (e.g., from human cDNA), because self-reactive antibodies are removed by the donor's immune system via negative selection.

Still further, the present invention provides strategies that streamline and/or simplify certain aspects of library development and/or screening. For example, in some embodiments, the present invention permits use of cell sorting technologies (e.g., fluorescence activated cell sorting, FACS) to identify positive clones, and therefore bypasses or obviates the need for the standard and tedious methodology of generating a hybridoma library and supernatant screening.

Yet further, in some embodiments, the present invention provides libraries and/or sublibraries that accommodate multiple screening passes. For example, in some embodiments, provided libraries and/or sublibraries can be screened multiple times. In some such embodiments, individual provided libraries and/or sublibraries can be used to discover additional antibodies against many targets.

Before further description of the invention, certain terms are defined.

Definitions

Unless defined otherwise, all technical and scientific terms used herein have the meaning commonly understood by one of ordinary skill in the art relevant to the invention. Unless otherwise specified, the Kabat numbering system is used throughout the application. The definitions below supplement those in the art and are directed to the embodiments described in the current application.

The term "amino acid" or "amino acid residue," as would be understood by one of ordinary skill in the art, typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (H is or H); isoleucine (Ile or I): leucine (Leu or L); lysine (Lys or K); methionine (Met or M); phenylalanine (Phe or F); proline (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a non-polar side chain (e.g., Ala, Cys, Ile, Leu, Met, Phe, Pro, Val); a negatively charged side chain (e.g., Asp, Glu); a positively charged side chain (e.g., Arg, His, Lys); or an uncharged polar side chain (e.g., Asn, Cys, Gln, Gly, His, Met, Phe, Ser, Thr, Trp, and Tyr).

As would be understood by those of ordinary skill in the art, the term "antibody" is used herein in the broadest sense and specifically encompasses at least monoclonal antibodies, polyclonal antibodies, multi-specific antibodies (e.g., bispecific antibodies), chimeric antibodies, humanized antibodies, human antibodies, and antibody fragments. An antibody is a protein comprising one or more polypeptides substantially or partially encoded by immunoglobulin genes or fragments of immunoglobulin genes. The recognized immunoglobulin genes include the kappa, lambda, alpha, gamma, delta, epsilon and mu constant region genes, as well as myriad immunoglobulin variable region genes.

The term "antibody binding region" refers to one or more portions of an immunoglobulin or antibody variable region capable of binding an antigen(s). Typically, the antibody binding region is, for example, an antibody light chain (or variable region or one or more CDRs thereof), an antibody heavy chain (or variable region or one or more CDRs thereof), a heavy chain Fd region, a combined antibody light and heavy chain (or variable regions thereof) such as a Fab, F(ab')$_2$, single domain, or single chain antibodies (scFv), or any region of a full length antibody that recognizes an antigen, for example, an IgG (e.g., an IgG1, IgG2, IgG3, or IgG4 subtype), IgA1, IgA2, IgD, IgE, or IgM antibody.

"Antibody fragments" comprise a portion of an intact antibody, for example, one or more portions of the antigen-binding region thereof. Examples of antibody fragments include Fab, Fab', F(ab')$_2$, and Fv fragments, diabodies, linear antibodies, single-chain antibodies, and multi-specific antibodies formed from intact antibodies and antibody fragments.

The term "antibody of interest" refers to an antibody that has a property of interest that is identified and/or isolated from a library of the invention. Exemplary properties of interest include, for example, but are not limited to, binding to a particular antigen or epitope, binding with a certain affinity, cross-reactivity, blocking a binding interaction between two molecules, and/or eliciting a certain biological effect.

The term "canonical structure," as understood by those of ordinary skill in the art, refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol., 1996, 263: 800, each of which is incorporated by reference in its entirety). Furthermore, there is a relationship between the adopted loop structure and the amino acid sequences surrounding it. As is known in the art, the conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues. The term "canonical structure" may also include considerations as to the linear sequence of the antibody, for example, as catalogued by Kabat (Kabat et al., in "Sequences of Proteins of Immunological Interest," 5$^{th}$ Edition, U.S. Department of Heath and Human Services, 1992). The Kabat numbering scheme is a widely adopted standard for numbering the amino acid residues of an antibody variable domain in a consistent manner, and is used herein unless indicated otherwise. Additional structural considerations can also be used to determine the canonical structure of an antibody. For example, those differences not fully reflected by Kabat numbering can be described by the numbering system of Chothia et al. and/or revealed by other techniques, for example, crystallography and two or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., and their implications for construing canonical aspects of antibody structure, are described in the literature.

The terms "CDR", and its plural "CDRs", refer to a complementarity determining region (CDR) of which three make up the binding character of a light chain variable region (CDRL1, CDRL2 and CDRL3) and three make up the binding character of a heavy chain variable region (CDRH1, CDRH2 and CDRH3). CDRs contribute to the functional activity of an antibody molecule and are separated by amino acid sequences that comprise framework regions. The exact definitional CDR boundaries and lengths are subject to different classification and numbering systems. CDRs may therefore be referred to by Kabat, Chothia, contact or other boundary definitions, including for example the CDRH3 numbering system described below. Despite differing boundaries, each of these systems has some degree of overlap in what constitutes the so called "hypervariable regions" within the variable region. CDR definitions according to these systems may therefore differ in length and boundary areas with respect to the adjacent framework region. See, for example Kabat et al., in "Sequences of Proteins of Immunological Interest," 5$^{th}$ Edition, U.S. Department of Health and Human Services, 1992; Chothia et al., J. Mol. Biol., 1987, 196: 901; and MacCallum et al., J. Mol. Biol., 1996, 262: 732, each of which is incorporated by reference in its entirety.

The "CDRH3 numbering system" used herein defines the first amino acid of CDRH3 as being at position 95 and the last amino acid of CDRH3 as position 102. Note that this is a custom numbering system that is not according to Kabat. The amino acid segment, beginning at position 95 is called "TN1" and, when present, is assigned numbers 95, 96, 96A, 96B, etc. Note that the nomenclature used in the current application is slightly different from that used in U.S. Publication Nos. 2009/0181855 and 2010/0056386, and WO/2009/036379. In those applications, position 95 was designated a "Tail" residue, while here, the Tail (T) has been combined with the N1 segment, to produce one segment, designated "TN1." The TN1 segment is followed by the "DH" segment, which is assigned numbers 97, 97A, 97B, 97C, etc. The DH segment is followed by the "N2" segment, which, when present, is numbered 98, 98A, 98B, etc. Finally, the most C-terminal amino acid residue of the "H3-JH" segment is designated as number 102. The residue directly before (N-terminal) it, when present, is 101, and the one before (if present) is 100. The rest of the H3-JH amino acids are numbered in reverse order, beginning with 99 for the amino acid just N-terminal to 100, 99A for the residue N-terminal to 99, and so forth for 99B, 99C, etc. Examples of CDRH3 sequence residue numbers may therefore include the following:

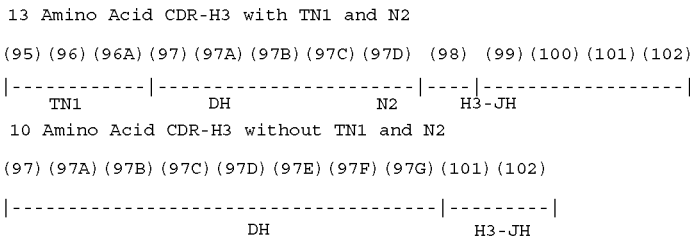

"Chassis" of the invention are portions of the antibody heavy chain variable (IGHV) or light chain variable (IGLV) domains that are not part of CDRH3 or CDRL3, respectively. A chassis of the invention is defined as the portion of the variable region of an antibody beginning with the first amino acid of FRM1 and ending with the last amino acid of FRM3. In the case of the heavy chain, the chassis includes the amino acids including from position 1 to position 94. In the case of the light chains (kappa and lambda), the chassis are defined as including from position 1 to position 88. The chassis of the invention may contain certain modifications relative to the corresponding germline variable domain sequences. These modifications may be engineered (e.g., to remove N-linked glycosylation sites) or naturally occurring (e.g., to account for naturally occurring allelic variation). For example, it is known in the art that the immunoglobulin gene repertoire is polymorphic (Wang et al., Immunol. Cell. Biol., 2008, 86: 111; Collins et al., Immunogenetics, 2008, 60: 669, each incorporated by reference in its entirety); chassis, CDRs and constant regions representative of these allelic variants are also encompassed by the invention. In some embodiments, the allelic variant(s) used in a particular embodiment of the invention may be selected based on the allelic variation present in different patient populations, for example, to identify antibodies that are non-immunogenic in these patient populations. In certain embodiments, the immunogenicity of an antibody of the invention may depend on allelic variation in the major histocompatibility complex (MHC) genes of a patient population. Such allelic variation may also be considered in the design of libraries of the invention. In certain embodiments of the invention, the chassis and constant regions are contained in a vector, and a CDR3 region is introduced between them via homologous recombination.

As used herein, a sequence designed with "directed diversity" has been specifically designed to contain both sequence diversity and length diversity. Directed diversity is not stochastic.

As used herein, the term "diversity" refers to a variety or a noticeable heterogeneity. The term "sequence diversity" refers to a variety of sequences which are collectively representative of several possibilities of sequences, for example, those found in natural human antibodies. For example, CDRH3 sequence diversity may refer to a variety of possibilities of combining the known human TN1, DH, N2, and H3-JH segments to form CDRH3 sequences. The CDRL3 sequence diversity (kappa or lambda) may refer to a variety of possibilities of combining the naturally occurring light chain variable region contributing to CDRL3 (i.e., "L3-VL") and joining (i.e., "L3-JL") segments, to form CDRL3 sequences. As used herein, "H3-JH" refers to the portion of the IGHJ gene contributing to CDRH3. As used herein, "L3-VL" and "L3-JL" refer to the portions of the IGLV and IGLJ genes (kappa or lambda) contributing to CDRL3, respectively.

As used herein, the term "expression" refers to steps involved in the production of a polypeptide including, but not limited to, transcription, post-transcriptional modification, translation, post-translational modification, and secretion.

The term "framework region" refers to the art-recognized portions of an antibody variable region that exist between the more divergent (i.e., hypervariable) CDRs. Such framework regions are typically referred to as frameworks 1 through 4 (FRM1, FRM2, FRM3, and FRM4) and provide a scaffold for the presentation of the six CDRs (three from the heavy chain and three from the light chain) in three dimensional space, to form an antigen-binding surface.

The term "full-length heavy chain" refers to an immunoglobulin heavy chain that contains each of the canonical structural domains of an immunoglobulin heavy chain, including the four framework regions, the three CDRs, and the constant region.

The term "full-length light chain" refers to an immunoglobulin light chain that contains each of the canonical structural domains of an immunoglobulin light chain, including the four framework regions, the three CDRs, and the constant region.

The term "germline-like," when used with respect to the CDRL3 sequences of the light chains of the invention, means those sequences consisting of combinations of: (i) the first six wild-type residues contributed to CDRL3 by the IGVL germline gene (i.e., positions 89 to 94 in the Kabat numbering system; "L" is kappa or lambda); and (ii) one of several amino acid sequences, two one to four amino acids in length, largely, but not exclusively, derived from the JL segment ("L," again is kappa or lambda). For kappa CDRL3 sequences of the most common lengths (i.e., 8, 9, and 10 residues), the sequences of (ii) number twenty and are: FT, LT, IT, RT, WT, YT, [X]T, [X]PT, [X]FT, [X]LT, [X]IT, [X]RT, [X]WT, [X]YT, [X]PFT, [X]PLT, [X]PIT, [X]PRT, [X]PWT and [X]PYT, where [X] corresponds to the amino acid residue found at position 95 (Kabat) in the respective VK germline sequence. X is most commonly P, but may also be S or any other amino acid residue found at position 95 of a VK germline sequence. For eight exemplified VK chassis exemplified herein, the corresponding 160 germline-like sequences, (i.e., 20 sequences of two to four amino acids in length combined with positions 89 to 94 of each of eight VK germline sequences) are provided in Table 1. A similar approach is applied to define germline-like CDRL3 sequences for lambda light chains. As for the kappa sequences described above, the intact, un-mutated portions of CDRL3 encoded by the IGVL genes (in this case, IGVλ) would be combined with the sequences largely, but not exclusively, derived from the Jλ segment. Here, the latter sequences (corresponding to (ii), above), number five and are: YV, VV, WV, AV or V. In addition, and as described in Example 7 of US 2009/0818155, one could further allow for variation at the last position of the Vλ-gene-encoded portion of CDRL3 by considering partial codons, while still considering the resulting sequences "germline-like." More specifically, the entire "minimalist library" of Example 7 in US 2009/0818155 would be defined as "germline-like." One of ordinary skill in the art will readily recognize that these methods can be extended to other VK and Vλ sequences.

The term "genotype-phenotype linkage," as understood by those of ordinary skill in the art, refers to the fact that the nucleic acid (genotype) encoding a protein with a particular phenotype (e.g., binding an antigen) can be isolated from a library. For the purposes of illustration, an antibody fragment expressed on the surface of a phage can be isolated based on its binding to an antigen (e.g., U.S. Pat. No. 5,837,500). The binding of the antibody to the antigen simultaneously enables the isolation of the phage containing the nucleic acid encoding the antibody fragment. Thus, the phenotype (antigen-binding characteristics of the antibody fragment) has been "linked" to the genotype (nucleic acid encoding the antibody fragment). Other methods of maintaining a genotype-phenotype linkage include those of Wittrup et al. (U.S. Pat. Nos. 6,300,065, 6,331,391, 6,423,538, 6,696,251, 6,699,658, and U.S. Pub. No. 20040146976, each of which is incorporated by reference in its entirety), Miltenyi (U.S. Pat. No. 7,166,423, incorporated by reference in its entirety), Fandl (U.S. Pat. No. 6,919,183, US Pub No. 20060234311, each incorporated by reference in its entirety), Clausell-Tormos et al. (Chem. Biol., 2008, 15: 427, incorporated by reference in its entirety), Love et al. (Nat. Biotechnol., 2006, 24: 703, incorporated by reference in its entirety), and Kelly et al. (Chem. Commun., 2007, 14: 1773, incorporated by reference in its entirety). The term can be used to refer to any method which localizes an antibody protein together with the gene encoding the antibody protein, in a way in which they can both be recovered while the linkage between them is maintained.

The term "heterologous moiety" is used herein to indicate the addition of a moiety to an antibody wherein the moiety is not part of a naturally-occurring antibody. Exemplary heterologous moieties include drugs, toxins, imaging agents, and any other compositions which might provide an activity that is not inherent in the antibody itself.

As used herein, the term "host cell" is intended to refer to a cell comprising a polynucleotide of the invention. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term "human antibody CDR library" includes at least a polynucleotide or polypeptide library which has been designed to represent the sequence diversity and length diversity of naturally occurring CDRs in human antibodies (e.g., the term "CDR" in "human antibody CDR library" may be substituted with "CDRL1," "CDRL2," "CDRL3," "CDRH1," "CDRH2," and/or "CDRH3"). Known human CDR sequences are represented in various data sets, including Jackson et al., J. Immunol. Methods, 2007, 324: 26; Martin, Proteins, 1996, 25: 130; Lee et al., Immunogenetics, 2006, 57: 917, Boyd et al., Science Translational Medicine, 2009, 1: 1, and WO/2009/036379, each of which is incorporated by reference in its entirety, and the HPS, which is provided in Appendix A.

The term "Human Preimmune Set," or "HPS," refers to a reference set of 3,571 curated human preimmune heavy chain sequences corresponding to the GI Nos. provided in Appendix A.

An "intact antibody" is one comprising full-length heavy- and light-chains (i.e., four frameworks, three CDRs, and a constant region for each of the heavy and light chains). An intact antibody is also referred to as a "full-length" antibody.

The term "length diversity" refers to a variety in the length of a family of nucleotide or amino acid sequence. For example, in naturally occurring human antibodies, the heavy chain CDR3 sequence varies in length, for example, from about 2 amino acids to over about 35 amino acids, and the light chain CDR3 sequence varies in length, for example, from about 5 to about 16 amino acids.

The term "library" refers to a set of entities comprising two or more entities having diversity as described herein, and/or designed according to the methods of the invention. For example, a "library of polynucleotides" refers to a set of polynucleotides comprising two or more polynucleotides having diversity as described herein, and/or designed according to the methods of the invention. A "library of polypeptides" refers to a set of polypeptides comprising two or more polypeptides having diversity as described herein, and/or designed according to the methods of the invention. A "library of synthetic polynucleotides" refers to a set of polynucleotides comprising two or more synthetic polynucleotides having diversity as described herein, and/or designed according to the methods of the invention. Libraries where all members are synthetic are also encompassed by the invention. A "human antibody library" refers to a set of polypeptides comprising two or more polypeptides having diversity as described herein, and/or designed according to the methods of the invention, for example a library designed to represent the sequence diversity and length diversity of naturally occurring human antibodies. In some embodiments, the term "library" may refer to a set of entities sharing similar structural or sequence characteristics, for example, a "heavy chain library," "light chain library," "antibody library," and/or "CDRH3 library."

The term "physical realization" refers to a portion of a theoretical (e.g., computer-based) or synthetic (e.g., oligonucleotide-based) diversity that can actually be physically sampled, for example, by any display methodology. Exemplary display methodology include: phage display, ribosomal display, and yeast display. For synthetic sequences, the size of the physical realization of a library depends on (1) the fraction of the theoretical diversity that can actually be synthesized, and (2) the limitations of the particular screening method. Exemplary limitations of screening methods include the number of variants that can be screened in a particular assay (e.g., ribosome display, phage display, yeast display) and the transformation efficiency of the host cells (e.g., yeast, mammalian cells, bacteria) which are used in a screening assay. For the purposes of illustration, given a library with a theoretical diversity of $10^{12}$ members, an exemplary physical realization of the library (e.g., in yeast, bacterial cells, or ribosome display) that can maximally include $10^{11}$ members will, therefore, sample about 10% of the theoretical diversity of the library. However, if fewer than $10^{11}$ members of the library with a theoretical diversity of $10^{12}$ are synthesized, and the physical realization of the library can maximally include $10^{11}$ members, less than 10% of the theoretical diversity of the library is sampled in the physical realization of the library. Similarly, a physical realization of the library that can maximally include more than $10^{12}$ members would "oversample" the theoretical diversity, meaning that each member may be present more than once (assuming that the entire $10^{12}$ theoretical diversity is synthesized).

The term "polynucleotide(s)" refers to nucleic acids such as DNA molecules and RNA molecules and analogs thereof (e.g., DNA or RNA generated using nucleotide analogs or using nucleic acid chemistry). As desired, the polynucleotides may be made synthetically, e.g., using art-recognized nucleic acid chemistry or enzymatically using, e.g., a polymerase, and, if desired, be modified. Typical modifications include methylation, biotinylation, and other art-known modifications. In addition, the nucleic acid molecule can be single-stranded or double-stranded and, where desired, linked to a detectable moiety. The representation of nucleotide bases herein follows International Union of Pure and Applied Chemistry (IUPAC) nomenclature (see U.S. Pub. No. 2009/0181855, incorporated by reference in its entirety).

"Preimmune" antibody libraries have sequence diversities and length diversities similar to naturally occurring human antibody sequences before these sequences have undergone negative selection and/or somatic hypermutation. For example, the set of sequences described in Lee et al. (Immunogenetics, 2006, 57: 917, incorporated by reference in its entirety) and the Human Preimmune Set (HPS) described herein (see Appendix A) are believed to represent sequences from the preimmune repertoire. In certain embodiments of the invention, the sequences of the invention will be similar to these sequences (e.g., in terms of composition and length).

As used herein, the term "sitewise stochastic" describes a process of generating a sequence of amino acids, where only the amino acid occurrences at the individual positions are considered, and higher order motifs (e.g., pair-wise correlations) are not accounted for (e.g., see Knappik, et al., J Mol Biol, 2000, 296: 57, and analysis provided in U.S. Publication No. 2009/0181855, each incorporated by reference in its entirety).

The term "split-pool synthesis" refers to a procedure in which the products of a plurality of individual first reactions are combined (pooled) and then separated (split) before participating in a plurality of second reactions. For example, U.S. Publication No. 2009/0181855 (incorporated by reference in its entirety) describes the synthesis of 278 DH segments (products), each in a separate reaction. After synthesis, these 278 segments are combined (pooled) and then distributed (split) amongst 141 columns for the synthesis of the N2 segments. This enables the pairing of each of the 278 DH segments with each of 141 N2 segments.

As used herein, "stochastic" describes a process of generating a random sequence of nucleotides or amino acids, which is considered as a sample of one element from a probability distribution (e.g., see U.S. Pat. No. 5,723,323).

As used herein, the term "synthetic polynucleotide" refers to a molecule formed through a chemical process, as opposed to molecules of natural origin, or molecules derived via template-based amplification of molecules of natural origin (e.g., immunoglobulin chains cloned from populations of B cells via PCR amplification are not "synthetic" as used herein). In some instances, for example, when referring to libraries of the invention that comprise multiple segments (e.g., TN1, DH, N2, and/or H3-JH), the invention encompasses libraries in which at least one, two, three, or four of the aforementioned components is synthetic. By way of illustration, a library in which certain components are synthetic, while other components are of natural origin or derived via template-based amplification of molecules of natural origin, would be encompassed by the invention. Libraries that are fully synthetic would, of course, also be encompassed by the invention.

The term "theoretical diversity" refers to the maximum number of variants in a library design. For example, given an amino acid sequence of three residues, where residues one and three may each be any one of five amino acid types and residue two may be any one of 20 amino acid types, the theoretical diversity is 5×20×5=500 possible sequences. Similarly if sequence X is constructed by combination of 4 amino acid segments, where segment 1 has 100 possible sequences, segment 2 has 75 possible sequences, segment 3 has 250 possible sequences, and segment 4 has 30 possible sequences, the theoretical diversity of fragment X would be 100×75×200×30, or $5.6×10^5$ possible sequences.

The term "theoretical segment pool" refers to a set of polynucleotide or polypeptide segments that can be used as building blocks to assemble a larger polynucleotide or polypeptide. For example, a theoretical segment pool containing TN1, DH, N2, and H3-JH segments can be used to assemble a library of CDRH3 sequences by concatenating them combinatorially to form a sequence represented by [TN1]-[DH]-[N2]-[H3-JH], and synthesizing the corresponding oligonucleotide(s). The term "theoretical segment pool" can apply to any set of polynucleotide or polypeptide segments. Thus, while a set of TN1, DH, N2, and H3-JH segments are collectively considered a theoretical segment pool, each of the individual sets of segments also comprise a theoretical segment pool, specifically a TN1 theoretical segment pool, a DH theoretical segment pool, an N2 theoretical segment pool, and an H3-JH theoretical segment pool. Any subsets of these theoretical segment pools containing two or more sequences can also be considered theoretical segment pools.

The term "unique," as used herein, refers to a sequence that is different (e.g., has a different chemical structure) from every other sequence within the designed set (e.g., the theoretical diversity). It should be understood that there are likely to be more than one copy of many unique sequences from the theoretical diversity in a particular physical realization. For example, a library comprising three unique sequences at the theoretical level may comprise nine total members if each sequence occurs three times in the physical realization of the library. However, in certain embodiments, each unique sequence may occur only once, less than once, or more than once.

The term "variable" refers to the portions of the immunoglobulin domains that exhibit variability in their sequence and that are involved in determining the specificity and binding affinity of a particular antibody (i.e., the "variable domain(s)"). Variability is not evenly distributed throughout the variable domains of antibodies; it is concentrated in sub-domains of each of the heavy and light chain variable regions. These sub-domains are called "hypervariable" regions or "complementarity determining regions" (CDRs). The more conserved (i.e., non-hypervariable) portions of the variable domains are called the "framework" regions (FRM). The variable domains of naturally occurring heavy and light chains each comprise four FRM regions, largely adopting a 13-sheet configuration, connected by three hypervariable regions, which form loops connecting, and in some cases forming part of, the 13-sheet structure. The hypervariable regions in each chain are held together in close proximity by the FRM and, with the hypervariable regions from the other chain, contribute to the formation of the antigen-binding site (see Kabat et al. Sequences of Proteins of Immunological Interest, 5th Ed. Public Health Service, National Institutes of Health, Bethesda, Md., 1991, incorporated by reference in its entirety). The constant domains are not directly involved in antigen binding, but exhibit various effector functions, such as, for example, antibody-dependent, cell-mediated cytotoxicity and complement activation.

Libraries of the invention containing "VKCDR3" sequences and "VλCDR3" sequences refer to the kappa and lambda sub-sets of the light chain CDR3 (CDRL3) sequences, respectively. Such libraries may be designed with directed diversity, to collectively represent the length and sequence diversity of the human antibody CDRL3 repertoire. "Preimmune" versions of these libraries have similar sequence diversities and length diversities as naturally occurring human antibody CDRL3 sequences before these sequences undergo negative selection and/or somatic hypermutation. Known human CDRL3 sequences are represented in various data sets, including the NCBI database, WO/2009/036379, and Martin, Proteins, 1996, 25: 130 each incorporated by reference in its entirety.

General Design of Libraries

Antibody libraries provided by the present invention may be designed to reflect certain aspects of the preimmune repertoire as created by the human immune system. Certain libraries of the invention are based on rational design informed by collections of human V, D, and J genes, and large databases of human heavy and light chain sequences (e.g., publicly known germline sequences and sequences from Jackson et al., J. Immunol. Methods, 2007, 324: 26; Lee et al., Immunogenetics, 2006, 57: 917; Boyd et al., Science Translational Medicine, 2009, 1: 1-8, each incorporated by reference in its entirety; and sequences compiled from rearranged VK and Vλ sequences (see WO/2009/036379, also incorporated by reference in its entirety). Additional information may be found, for example, in Scaviner et al., Exp. Clin. Immunogenet., 1999, 16: 234; Tomlinson et al., J. Mol. Biol., 1992, 227: 799; and Matsuda et al., J. Exp. Med., 1998, 188: 2151, each incorporated by reference in its entirety.

In certain embodiments of the invention, segments representing the possible V, D, and J diversity found in the human repertoire, as well as junctional diversity (i.e., TN1 and N2), are synthesized de novo as single or double-stranded DNA oligonucleotides. In certain embodiments of the invention, oligonucleotides encoding CDR sequences are introduced into yeast along with one or more acceptor vectors containing heavy or light chain chassis sequences and constant domains. No primer-based PCR amplification or template-directed cloning steps from mammalian cDNA or mRNA are employed. Through standard homologous recombination, the recipient yeast recombines the CDR segments with the acceptor vectors containing the chassis sequences and constant regions, to create a properly ordered synthetic, full-length human heavy chain and/or light chain immunoglobulin library that can be genetically propagated, expressed, presented, and screened. One of ordinary skill in the art will readily recognize that the acceptor vector can be designed so as to produce constructs other than full-length human heavy chains and/or light chains. For example, in certain embodiments of the invention, the chassis may be designed to encode portions of a polypeptide encoding an antibody fragment or subunit of an antibody fragment, so that a sequence encoding an antibody fragment, or subunit thereof, is produced when the oligonucleotide cassette containing the CDR is recombined with the acceptor vector.

Thus, in certain embodiments, the invention provides a synthetic, preimmune human antibody repertoire the repertoire comprising:

(a) one or more selected human antibody heavy chain chassis (i.e., amino acids 1 to 94 of the heavy chain variable region, using Kabat's definition);

(b) a CDRH3 repertoire (described more fully below), designed based on the human IGHD and IGHJ germline sequences, and the extraction of TN1 and N2 sequences from reference sets of human CDRH3 sequences, the CDRH3 repertoire comprising (i) a TN1 segment; (ii) a DH segment; (iii) an N2 segment; (iv) an H3-JH segment.

(c) one or more selected human antibody kappa and/or lambda light chain chassis; and (d) a CDRL3 repertoire designed based on the human IGLV and IGLJ germline sequences, wherein "L" may be a kappa or lambda light chain.

The instant invention also provides methods for producing and using such libraries, as well as libraries comprising one or more immunoglobulin domains or antibody fragments. Design and synthesis of each component of the antibody libraries of the invention is provided in more detail below.

Design of Antibody Library Chassis Sequences

In certain embodiments, provided libraries are constructed from selected chassis sequences that are based on naturally occurring variable domain sequences (e.g., IGHV and IGLV genes). The selection of such chassis sequences can be done arbitrarily, or through the definition of certain pre-determined criteria. For example, the Kabat database, an electronic database containing non-redundant rearranged antibody sequences, can be queried for those heavy and light chain germline sequences that are most frequently represented. An algorithm such as BLAST, or a more specialized tool such as SoDA (Volpe et al., Bioinformatics, 2006, 22: 438-44, incorporated by reference in its entirety), can be used to compare rearranged antibody sequences with germline sequences (e.g., using the V BASE2 database; see, for example, Retter et al., Nucleic Acids Res., 2005, 33: D671-D674, incorporated by reference in its entirety), or similar collections of human V, D, and J genes, to identify germline families that are most frequently used to generate functional antibodies.

Several criteria can be utilized for the selection of chassis for inclusion in the libraries of the invention. For example, sequences that are known (or have been determined) to express poorly in yeast, or other organisms used in the invention (e.g., bacteria, mammalian cells, fungi, or plants) can be excluded from the libraries. Chassis may also be chosen based on the representation of their corresponding germline genes in the peripheral blood of humans. In certain embodiments of the invention, it may be desirable to select chassis that correspond to germline sequences that are highly represented in the peripheral blood of humans. In some embodiments, it may be desirable to select chassis that correspond to germline sequences that are less frequently represented, for example, to increase the canonical diversity of the library. Therefore, chassis may be selected to produce libraries that represent the largest and most structurally diverse group of functional human antibodies.

In certain embodiments of the invention, less diverse chassis may be utilized, for example, if it is desirable to produce a smaller, more focused library with less chassis variability and greater CDR variability. In some embodiments of the invention, chassis may be selected based on both their expression in a cell of the invention (e.g., a yeast cell) and the diversity of canonical structures represented by the selected sequences. One may therefore produce a library with a diversity of canonical structures that express well in a cell of the invention.

Design of Heavy Chain Chassis Sequences

The design and selection of heavy chain chassis sequences that can be used in the current invention is described in detail in U.S. Publication Nos. 2009/0181855 and 2010/0056386, and WO/2009/036379, each of which is incorporated by reference in its entirety, and is therefore described only briefly here.

In general, VH domains of the library comprise three components: (1) a VH "chassis," which includes amino acids 1 to 94 (using Kabat numbering), (2) the CDRH3, which is defined herein to include the Kabat CDRH3 proper (positions 95-102), and (3) the FRM4 region, including amino acids 103 to 113 (Kabat numbering). The overall VH domain structure may therefore be depicted schematically (not to scale) as:

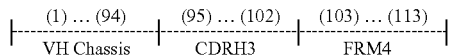

In certain embodiments of the invention, the VH chassis of the libraries may comprise from about Kabat residue 1 to about Kabat residue 94 of one or more of the following IGHV germline sequences: IGHV1-2, IGHV1-3, IGHV1-8, IGHV1-18, IGHV1-24, IGHV1-45, IGHV1-46, IGHV1-58, IGHV1-69, IGH8, IGH56, IGH100, IGHV3-7, IGHV3-9, IGHV3-11, IGHV3-13, IGHV3-15, IGHV3-20, IGHV3-21, IGHV3-23, IGHV3-30, IGHV3-33, IGHV3-43, IGHV3-48, IGHV3-49, IGHV3-53, IGHV3-64, IGHV3-66, IGHV3-72, IGHV3-73, IGHV3-74, IGHV4-4, IGHV4-28, IGHV4-31, IGHV4-34, IGHV4-39, IGHV4-59, IGHV4-61, IGHV4-B, IGHV5-51, IGHV6-1, and/or IGHV7-4-1. In some embodiments of the invention, a library may contain one or more of these sequences, one or more allelic variants of these sequences, or encode an amino acid sequence at least about 99.9%, 99.5%, 99%, 98.5%, 98%, 97.5%, 97%, 96.5%, 96%, 95.5%, 95%, 94.5%, 94%, 93.5%, 93%, 92.5%, 92%, 91.5%, 91%, 90.5%, 90%, 89%, 88%, 87%, 86%, 85%, 84%, 83%, 82%, 81%, 80%, 77.5%, 75%, 73.5%, 70%, 65%, 60%, 55%, or 50% identical to one or more of these sequences. One of ordinary skill in the art will recognize that given the chassis definition provided above, any IGHV-encoding sequence can be adapted for use as a chassis of the invention. As exemplified in U.S. Publication Nos. 2009/0181855 and 2010/0056386, and WO/2009/036379 (each incorporated by reference in its entirety), these chassis can also be varied, particularly by altering the amino acid residues in the CDRH1 and CDRH2 regions, further increasing the diversity of the library.

Design of Light Chain Chassis Sequences

The design and selection of light chain chassis sequences that can be used in the current invention is described in detail in U.S. Publication Nos. 2009/0181855 and 2010/0056386, and WO/2009/036379, each of which is incorporated by reference in its entirety, and is therefore described only briefly here. The light chain chassis of the invention may be based on kappa and/or lambda light chain sequences.

The VL domains of the library comprise three primary components: (1) a VL "chassis", which includes amino acids 1 to 88 (using Kabat numbering), (2) the CDRL3, which is defined herein to include the Kabat CDRL3 proper (positions 89-97), and (3) the FRM4 region, including amino acids 98 to 107 (Kabat numbering). The overall VL domain structure may therefore be depicted schematically (not to scale) as:

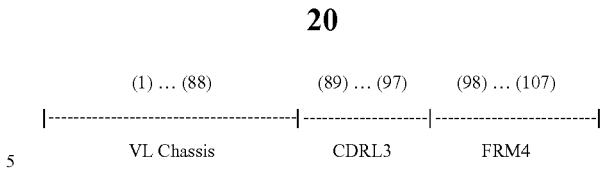

In certain embodiments of the invention, the VL chassis of the libraries include one or more chassis based on IGKV germline sequences. In certain embodiments of the invention, the VL chassis of the libraries may comprise from about Kabat residue 1 to about Kabat residue 88 of one or more of the following IGKV germline sequences: IGKV1-05, IGKV1-06, IGKV1-08, IGKV1-09, IGKV1-12, IGKV1-13, IGKV1-16, IGKV1-17, IGKV1-27, IGKV1-33, IGKV1-37, IGKV1-39, IGKV1D-16, IGKV1D-17, IGKV1D-43, IGKV1D-8, IGK54, IGK58, IGK59, IGK60, IGK70, IGKV2D-26, IGKV2D-29, IGKV2D-30, IGKV3-11, IGKV3-15, IGKV3-20, IGKV3D-07, IGKV3D-11, IGKV3D-20, IGKV4-1, IGKV5-2, IGKV6-21, and/or IGKV6D-41. In some embodiments of the invention, a library may contain one or more of these sequences, one or more allelic variants of these sequences, or encode an amino acid sequence at least about 99.9%, 99.5%, 99%, 98.5%, 98%, 97.5%, 97%, 96.5%, 96%, 95.5%, 95%, 94.5%, 94%, 93.5%, 93%, 92.5%, 92%, 91.5%, 91%, 90.5%, 90%, 89%, 88%, 87%, 86%, 85%, 84%, 83%, 82%, 81%, 80%, 77.5%, 75%, 73.5%, 70%, 65%, 60%, 55%, or 50% identical to one or more of these sequences.

In certain embodiments of the invention, the VL chassis of the libraries include one or more chassis based on IGλV germline sequences. In certain embodiments of the invention, the VL chassis of the libraries may comprise from about Kabat residue 1 to about Kabat residue 88 of one or more of the following IGλV germline sequences: IGλV3-1, IGλV3-21, IGλ44, IGλV1-40, IGλV3-19, IGλV1-51, IGλV1-44, IGλV6-57, IGλ11, IGλV3-25, IGλ53, IGλV3-10, IGλV4-69, IGλV1-47, IGλ41, IGλV7-43, IGλV7-46, IGλV5-45, IGλV4-60, IGλV10-54, IGλV8-61, IGλV3-9, IGλV1-36, IGλ48, IGλV3-16, IGλV3-27, IGλV4-3, IGλV5-39, IGλV9-49, and/or IGλV3-12. In some embodiments of the invention, a library may contain one or more of these sequences, one or more allelic variants of these sequences, or encode an amino acid sequence at least about 99.9%, 99.5%, 99%, 98%, 97%, 96%, 95%, 94%, 93%, 92%, 91%, 90%, 85%, 80%, 75%, 70%, 65%, 60%, 55%, or 50% identical to one or more of these sequences.

One of ordinary skill in the art will recognize that given the chassis definition provided above, any IGKV- or IGλV-encoding sequence can be adapted for use as a chassis of the invention.

Design and Selection of TN1, DH, N2, and H3-JH Segments

The human germline repertoire contains at least six IGHJ genes (IGHJ1, IGHJ2, IGHJ3, IGHJ4, IGHJ5, and IGHJ6; included in Table 14, where the primary allele is designated "01," and selected allelic variants are designated "02" or "03"), and at least 27 IGHD genes (Table 16, including allelic variants). In some embodiments, the invention comprises a library of CDRH3 polypeptide sequences, or polynucleotide sequences encoding CDRH3 sequences, the library comprising members of any of the theoretical segment pools disclosed herein.

A person of ordinary skill in the art will recognize that not every segment in a theoretical segment pool provided herein is necessary to produce a functional CDRH3 library of the invention. Therefore, in certain embodiments, a CDRH3 library of the invention will contain a subset of the segments of any of the theoretical segment pools described herein. For example, in certain embodiments of the invention, at least about 15, 30, 45, 60, 75, 90, 100, 105, 120, 135, 150, 165, 180, 195, 200, 210, 225, 240, 255, 270, 285, 300, 320, 340, 360, 380, 400, 420, 440, 460, 480, 500, 520, 540, 560, 580, 600, 620, 640, or 643 of the H3-JH segments of any of the theoretical segment pools provided herein, or generated by the methods described herein, are included in a library. In some embodiments of the invention, at least about 15, 30, 45, 60, 75, 90, 100, 105, 120, 135, 150, 165, 180, 195, 200, 250, 300, 350, 400, 450, 500, 550, 600, 650, 700, 750, 800, 850, 900, 950, 1000, 1050, 1100, 1111, 2000, 3000, 4000, 5000, 6000, 7000, 14000, 21000, 28000, 35000, 42000, 49000, 56000, 63000, or 68374 of the DH segments of any of the theoretical segment pools provided herein, or generated by the methods described herein, are included in a library. In some embodiments of the invention, at least about 10, 20, 30, 40, 50, 60, 70, 80, 90, 100, 110, 120, 130, 140, 141, 150, 160, 170, 180, 190, or 200, 220, 240, 260, 280, 300, 320, 340, 360, 380, 400, 420, 424, 440, 460, 480, 500, 550, 600, 650, 700, 727, 750, 800, 850, 900, 950, or 1000 of the TN1 and/or N2 segments of any of the theoretical segment pools provided herein, or generated by the methods described herein, are included in a library. In certain embodiments, a library of the invention may contain less than a particular number of polynucleotide or polypeptide segments, where the number of segments is defined using any one of the integers provided above for the respective segment. In some embodiments of the invention, a particular numerical range is defined, using any two of the integers provided above as lower and upper boundaries of the range, inclusive or exclusive. All combinations of the integers provided, which define an upper and lower boundary, are contemplated.

In certain embodiments, the invention provides CDRH3 libraries comprising at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the segments from any of the theoretical segment pools provided herein. For example, the invention provides libraries comprising at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the TN1, DH, N2, and/or H3-JH segments from any of the theoretical segment pools provided herein. In some embodiments of the invention, a particular percentage range is defined, using any two of the percentages provided above as lower and upper boundaries of the range, inclusive or exclusive. All combinations of the percentages provided, which define an upper and lower boundary, are contemplated.

In some embodiments of the invention, at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the H3-JH, DH, TN1, and/or N2 segments in a CDRH3 library are H3-JH, DH, TN1, and/or N2 segments of any of the theoretical segment pools provided herein, or generated by the methods described herein. In some embodiments of the invention, at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the H3-JH, DH, TN1, and/or N2 segments of antibodies isolated from a CDRH3 library (e.g., by binding to a particular antigen and/or generic ligand through one or more rounds of selection) are H3-JH, DH, TN1, and/or N2 segments of any of the theoretical segment pools provided herein, or generated by methods described herein. In certain embodiments, a CDRH3 library of the invention may contain less than a particular percentage of H3-JH, DH, TN1, and/or N2 segments of any of the theoretical segment pools provided herein, or generated by the methods described herein, where the number of segments is defined using any one of the percentages provided above for the respective segment. In some embodiments of the invention, a particular percentage range is defined, using any two of the percentages provided above as lower and upper boundaries of the range, inclusive or exclusive. All combinations of the percentages provided, which define an upper and lower boundary, are contemplated.

One of ordinary skill in the art will appreciate, upon reading the disclosure herein, that given the TN1, DH, N2, and/or H3-JH segments of any of the theoretical segment pools provided herein, or generated by the methods described herein, similar TN1, DH, N2, and/or H3-JH segments, and corresponding CDRH3 libraries, could be produced which, while not 100% identical to those provided in terms of their sequences, may be functionally very similar. Such theoretical segment pools and CDRH3 libraries also fall within the scope of the invention. A variety of techniques well-known in the art could be used to obtain these additional sequences, including the mutagenesis techniques provided herein. Therefore, each of the explicitly enumerated embodiments of the invention can also be practiced using segments that share a particular percent identity to any of the segments of any of the theoretical segment pools provided herein, or generated by the methods described herein. For example, each of the previously described embodiments of the invention can be practiced using TN1, DH, N2, and/or H3-JH segments that are at least about 50%, 55%, 60%, 65%, 70%, 75%, 80%, 85%, 90%, 91%, 92%, 93%, 94%, 95%, 96%, 97%, 98%, 99%, 99.5%, or 99.9% identical to the TN1, DH, N2, and/or H3-JH segments of any of the theoretical segment pools provided herein, or generated by the methods described herein.

In some embodiments, the invention provides libraries produced from one or more VH chassis sequences combined with one or more TN1 segments, one or more DH segments, one or more N2 segments, and one or more H3-JH segments. In certain embodiments at least 1, 2, 5, 10, 20, 50, 75, or 100, of each chassis, TN1, DH, N2, or H3-JH segments are included in a library of the invention.

In some embodiments, the invention provides a method of selecting TN1, DH, N2, and H3-JH segments from a theoretical segment pool for inclusion in a synthetic CDRH3 library, comprising:
 (i) providing a theoretical segment pool containing one or more of TN1, DH, N2, and H3-JH segments;
 (ii) providing a reference set of CDRH3 sequences;
 (iii) utilizing the theoretical segment pool of (i) to identify the closest match(es) to each CDRH3 sequence in the reference set of (ii); and
 (iv) selecting segments from the theoretical segment pool for inclusion in a synthetic library.

In some embodiments, the selection process of (iv) can optionally involve any number of additional criteria, including the frequency of occurrence of the segments of (i) in the reference set of (ii); the corresponding segmental usage weights; and any physicochemical properties (see all numerical indices at www.genome.jp/aaindex/) of the segments (e.g., hydrophobicity, alpha-helical propensity, and/or isoelectric point). Optionally, TN1 and/or N2 segments that do not occur in the theoretical segment pool of (i) but that are found in the reference set of (ii) may be identified and added to prospective theoretical segment pools to produce theoretical segment pools with increased TN1 and/or N2 diversity in the prospective theoretical segment pools and/or synthetic libraries of the invention.

Any characteristic or set of characteristics of the segments can be used to choose them for inclusion in the library, including for example one or more biological properties (e.g., immunogenicity, stability, half-life) and/or one or more physicochemical properties such as the numerical indices provided above. In some embodiments, at least 1, 2, 3, 4, 5, 6, 7, 8, 9, 10, 11, 12, 13, 14, 15 or more such properties is used to select segments for inclusion in a library of the invention. Physiochemical properties included in the index provided above can include, for example, ANDN920101 alpha-CH chemical shifts (Andersen et al., 1992); ARGP820101 Hydrophobicity index (Argos et al., 1982); ARGP820102 Signal sequence helical potential (Argos et al., 1982); ARGP820103 Membrane-buried preference parameters (Argos et al., 1982); BEGF750101 Conformational parameter of inner helix (Beghin-Dirkx, 1975); BEGF750102 Conformational parameter of beta-structure (Beghin-Dirkx, 1975); BEGF750103 Conformational parameter of beta-turn (Beghin-Dirkx, 1975); BHAR880101 Average flexibility indices (Bhaskaran-Ponnuswamy, 1988); BIGC670101 Residue volume (Bigelow, 1967); BIOV880101 Information value for accessibility; average fraction 35% (Biou et al., 1988); BIOV880102 Information value for accessibility; average fraction 23% (Biou et al., 1988); BROC820101 Retention coefficient in TFA (Browne et al., 1982); BROC820102 Retention coefficient in HFBA (Browne et al., 1982); BULH740101 Transfer free energy to surface (Bull-Breese, 1974); BULH740102 Apparent partial specific volume (Bull-Breese, 1974); BUNA790101 alpha-NH chemical shifts (Bundi-Wuthrich, 1979); BUNA790102 alpha-CH chemical shifts (Bundi-Wuthrich, 1979); BUNA790103 Spin-spin coupling constants 3JHalpha-NH (Bundi-Wuthrich, 1979); BURA740101 Normalized frequency of alpha-helix (Burgess et al., 1974); BURA740102 Normalized frequency of extended structure (Burgess et al., 1974); CHAM810101 Steric parameter (Charton, 1981); CHAM820101 Polarizability parameter (Charton-Charton, 1982); CHAM820102 Free energy of solution in water, kcal/mole (Charton-Charton, 1982); CHAM830101 The Chou-Fasman parameter of the coil conformation (Charton-Charton, 1983); CHAM830102 A parameter defined from the residuals obtained from the best correlation of the Chou-Fasman parameter of beta-sheet (Charton-Charton, 1983); CHAM830103 The number of atoms in the side chain labelled 1+1 (Charton-Charton, 1983); CHAM830104 The number of atoms in the side chain labelled 2+1 (Charton-Charton, 1983); CHAM830105 The number of atoms in the side chain labelled 3+1 (Charton-Charton, 1983); CHAM830106 The number of bonds in the longest chain (Charton-Charton, 1983); CHAM830107 A parameter of charge transfer capability (Charton-Charton, 1983); CHAM830108 A parameter of charge transfer donor capability (Charton-Charton, 1983); CHOC750101 Average volume of buried residue (Chothia, 1975); CHOC760101 Residue accessible surface area in tripeptide (Chothia, 1976); CHOC760102 Residue accessible surface area in folded protein (Chothia, 1976); CHOC760103 Proportion of residues 95% buried (Chothia, 1976); CHOC760104 Proportion of residues 100% buried (Chothia, 1976); CHOP780101 Normalized frequency of beta-turn (Chou-Fasman, 1978a); CHOP780201 Normalized frequency of alpha-helix (Chou-Fasman, 1978b); CHOP780202 Normalized frequency of beta-sheet (Chou-Fasman, 1978b); CHOP780203 Normalized frequency of beta-turn (Chou-Fasman, 1978b); CHOP780204 Normalized frequency of N-terminal helix (Chou-Fasman, 1978b); CHOP780205 Normalized frequency of C-terminal helix (Chou-Fasman, 1978b); CHOP780206 Normalized frequency of N-terminal non helical region (Chou-Fasman, 1978b); CHOP780207 Normalized frequency of C-terminal non helical region (Chou-Fasman, 1978b); CHOP780208 Normalized frequency of N-terminal beta-sheet (Chou-Fasman, 1978b); CHOP780209 Normalized frequency of C-terminal beta-sheet (Chou-Fasman, 1978b); CHOP780210 Normalized frequency of N-terminal non beta region (Chou-Fasman, 1978b); CHOP780211 Normalized frequency of C-terminal non beta region (Chou-Fasman, 1978b); CHOP780212 Frequency of the 1st residue in turn (Chou-Fasman, 1978b); CHOP780213 Frequency of the 2nd residue in turn (Chou-Fasman, 1978b); CHOP780214 Frequency of the 3rd residue in turn (Chou-Fasman, 1978b); CHOP780215 Frequency of the 4th residue in turn (Chou-Fasman, 1978b); CHOP780216 Normalized frequency of the 2nd and 3rd residues in turn (Chou-Fasman, 1978b); CIDH920101 Normalized hydrophobicity scales for alpha-proteins (Cid et al., 1992); CIDH920102 Normalized hydrophobicity scales for beta-proteins (Cid et al., 1992); CIDH920103 Normalized hydrophobicity scales for alpha+beta-proteins (Cid et al., 1992); CIDH920104 Normalized hydrophobicity scales for alpha/beta-proteins (Cid et al., 1992); CIDH920105 Normalized average hydrophobicity scales (Cid et al., 1992); COHE430101 Partial specific volume (Cohn-Edsall, 1943); CRAJ730101 Normalized frequency of middle helix (Crawford et al., 1973); CRAJ730102 Normalized frequency of beta-sheet (Crawford et al., 1973); CRAJ730103 Normalized frequency of turn (Crawford et al., 1973); DAWD720101 Size (Dawson, 1972); DAYM780101 Amino acid composition (Dayhoff et al., 1978a); DAYM780201 Relative mutability (Dayhoff et al., 1978b); DESM900101 Membrane preference for cytochrome b: MPH89 (Degli Esposti et al., 1990); DESM900102 Average membrane preference: AMP07 (Degli Esposti et al., 1990); EISD840101 Consensus normalized hydrophobicity scale (Eisenberg, 1984); EISD860101 Solvation free energy (Eisenberg-McLachlan, 1986); EISD860102 Atom-based hydrophobic moment (Eisenberg-McLachlan, 1986); EISD860103 Direction of hydrophobic moment (Eisenberg-McLachlan, 1986); FASG760101 Molecular weight (Fasman, 1976); FASG760102 Melting point (Fasman, 1976); FASG760103 Optical rotation (Fasman, 1976); FASG760104 pK-N (Fasman, 1976); FASG760105 pK-C (Fasman, 1976); FAUJ830101 Hydrophobic parameter pi (Fauchere-Pliska, 1983); FAUJ880101 Graph shape index (Fauchere et al., 1988); FAUJ880102 Smoothed upsilon steric parameter (Fauchere et al., 1988); FAUJ880103 Normalized van der Waals volume (Fauchere et al., 1988); FAUJ880104 STERIMOL length of the side chain (Fauchere et al., 1988); FAUJ880105 STERIMOL minimum width of the side chain (Fauchere et al., 1988); FAUJ880106 STERIMOL maximum width of the side chain (Fauchere et al., 1988); FAUJ880107 N.m.r. chemical shift of alpha-carbon (Fauchere et al., 1988); FAUJ880108 Localized electrical effect (Fauchere et al., 1988); FAUJ880109 Number of hydrogen bond donors (Fauchere et al., 1988); FAUJ880110 Number of full nonbonding orbitals (Fauchere et al., 1988); FAUJ880111 Positive charge (Fauchere et al., 1988); FAUJ880112 Negative charge (Fauchere et al., 1988); FAUJ880113 pK-a(RCOOH) (Fauchere et al., 1988); FINA770101 Helix-coil equilibrium constant (Finkelstein-Ptitsyn, 1977); FINA910101 Helix initiation parameter at posision i-1 (Finkelstein et al., 1991); FINA910102 Helix initiation parameter at posision i, i+1, i+2 (Finkelstein et al., 1991); FINA910103 Helix termination parameter at position j-2, j-1,j (Finkelstein et al., 1991); FINA910104 Helix termination parameter at posision j+1 (Finkelstein et al., 1991); GARJ730101 Partition coefficient (Garel et al., 1973); GEIM800101 Alpha-helix indices (Geisow-Roberts, 1980);

GEIM800102 Alpha-helix indices for alpha-proteins (Geisow-Roberts, 1980); GEIM800103 Alpha-helix indices for beta-proteins (Geisow-Roberts, 1980); GEIM800104 Alpha-helix indices for alpha/beta-proteins (Geisow-Roberts, 1980); GEIM800105 Beta-strand indices (Geisow-Roberts, 1980); GEIM800106 Beta-strand indices for beta-proteins (Geisow-Roberts, 1980); GEIM800107 Beta-strand indices for alpha/beta-proteins (Geisow-Roberts, 1980) GEIM800108 Aperiodic indices (Geisow-Roberts, 1980); GEIM800109 Aperiodic indices for alpha-proteins (Geisow-Roberts, 1980); GEIM800110 Aperiodic indices for beta-proteins (Geisow-Roberts, 1980); GEIM800111 Aperiodic indices for alpha/beta-proteins (Geisow-Roberts, 1980); GOLD730101 Hydrophobicity factor (Goldsack-Chalifoux, 1973); GOLD730102 Residue volume (Goldsack-Chalifoux, 1973); GRAR740101 Composition (Grantham, 1974); GRAR740102Polarity (Grantham, 1974) GRAR740103 Volume (Grantham, 1974); GUYH850101 Partition energy (Guy, 1985); HOPA770101 Hydration number (Hopfinger, 1971), Cited by Charton-Charton (1982) HOPT810101 Hydrophilicity value (Hopp-Woods, 1981); HUTJ700101 Heat capacity (Hutchens, 1970); HUTJ700102 Absolute entropy (Hutchens, 1970); HUTJ700103 Entropy of formation (Hutchens, 1970); ISOY800101 Normalized relative frequency of alpha-helix (Isogai et al., 1980); ISOY800102 Normalized relative frequency of extended structure (Isogai et al., 1980); ISOY800103 Normalized relative frequency of bend (Isogai et al., 1980); ISOY800104 Normalized relative frequency of bend R (Isogai et al., 1980); ISOY800105 Normalized relative frequency of bend S (Isogai et al., 1980); ISOY800106 Normalized relative frequency of helix end (Isogai et al., 1980); ISOY800107 Normalized relative frequency of double bend (Isogai et al., 1980); ISOY800108 Normalized relative frequency of coil (Isogai et al., 1980); JANJ780101 Average accessible surface area (Janin et al., 1978); JANJ780102 Percentage of buried residues (Janin et al., 1978); JANJ780103 Percentage of exposed residues (Janin et al., 1978); JANJ790101 Ratio of buried and accessible molar fractions (Janin, 1979); JANJ790102 Transfer free energy (Janin, 1979); JOND750101 Hydrophobicity (Jones, 1975); JOND750102 pK (—COOH) (Jones, 1975); JOND920101 Relative frequency of occurrence (Jones et al., 1992); JOND920102 Relative mutability (Jones et al., 1992) JUKT750101 Amino acid distribution (Jukes et al., 1975); JUNJ780101 Sequence frequency (Jungck, 1978); KANM800101 Average relative probability of helix (Kanehisa-Tsong, 1980); KANM800102 Average relative probability of beta-sheet (Kanehisa-Tsong, 1980); KANM800103 Average relative probability of inner helix (Kanehisa-Tsong, 1980); KANM800104 Average relative probability of inner beta-sheet (Kanehisa-Tsong, 1980); KARP850101 Flexibility parameter for no rigid neighbors (Karplus-Schulz, 1985); KARP850102 Flexibility parameter for one rigid neighbor (Karplus-Schulz, 1985); KARP850103 Flexibility parameter for two rigid neighbors (Karplus-Schulz, 1985); KHAG800101 The Kerr-constant increments (Khanarian-Moore, 1980); KLEP840101 Net charge (Klein et al., 1984); KRIW710101 Side chain interaction parameter (Krigbaum-Rubin, 1971); KRIW790101 Side chain interaction parameter (Krigbaum-Komoriya, 1979); KRIW790102 Fraction of site occupied by water (Krigbaum-Komoriya, 1979); KRIW790103 Side chain volume (Krigbaum-Komoriya, 1979); KYTJ820101 Hydropathy index (Kyte-Doolittle, 1982); LAWE840101 Transfer free energy, CHP/water (Lawson et al., 1984); LEVM760101 Hydrophobic parameter (Levitt, 1976); LEVM760102 Distance between C-alpha and centroid of side chain (Levitt, 1976); LEVM760103 Side chain angle theta(AAR) (Levitt, 1976); LEVM760104 Side chain torsion angle phi(AAAR) (Levitt, 1976); LEVM760105 Radius of gyration of side chain (Levitt, 1976); LEVM760106 van der Waals parameter R0 (Levitt, 1976) LEVM760107 van der Waals parameter epsilon (Levitt, 1976); LEVM780101 Normalized frequency of alpha-helix, with weights (Levitt, 1978); LEVM780102 Normalized frequency of beta-sheet, with weights (Levitt, 1978); LEVM780103 Normalized frequency of reverse turn, with weights (Levitt, 1978); LEVM780104 Normalized frequency of alpha-helix, unweighted (Levitt, 1978); LEVM780105 Normalized frequency of beta-sheet, unweighted (Levitt, 1978); LEVM780106 Normalized frequency of reverse turn, unweighted (Levitt, 1978); LEWP710101 Frequency of occurrence in beta-bends (Lewis et al., 1971); LIFS790101 Conformational preference for all beta-strands (Lifson-Sander, 1979); LIFS790102 Conformational preference for parallel beta-strands (Lifson-Sander, 1979); LIFS790103 Conformational preference for antiparallel beta-strands (Lifson-Sander, 1979); MANP780101 Average surrounding hydrophobicity (Manavalan-Ponnuswamy, 1978); MAXF760101 Normalized frequency of alpha-helix (Maxfield-Scheraga, 1976); MAXF760102 Normalized frequency of extended structure (Maxfield-Scheraga, 1976); MAXF760103 Normalized frequency of zeta R (Maxfield-Scheraga, 1976); MAXF760104 Normalized frequency of left-handed alpha-helix (Maxfield-Scheraga, 1976); MAXF760105 Normalized frequency of zeta L (Maxfield-Scheraga, 1976); MAXF760106 Normalized frequency of alpha region (Maxfield-Scheraga, 1976); MCMT640101 Refractivity (McMeekin et al., 1964), Cited by Jones (1975); MEEJ800101 Retention coefficient in HPLC, pH7.4 (Meek, 1980); MEEJ800102 Retention coefficient in HPLC, pH2.1 (Meek, 1980); MEEJ810101 Retention coefficient in NaClO4 (Meek-Rossetti, 1981); MEEJ810102 Retention coefficient in NaH2PO4 (Meek-Rossetti, 1981); MEIH800101 Average reduced distance for C-alpha (Meirovitch et al., 1980); MEIH800102 Average reduced distance for side chain (Meirovitch et al., 1980); MEIH800103 Average side chain orientation angle (Meirovitch et al., 1980); MIYS850101 Effective partition energy (Miyazawa-Jernigan, 1985); NAGK730101 Normalized frequency of alpha-helix (Nagano, 1973); NAGK730102 Normalized frequency of bata-structure (Nagano, 1973) NAGK730103 Normalized frequency of coil (Nagano, 1973); NAKH900101 AA composition of total proteins (Nakashima et al., 1990); NAKH900102 SD of AA composition of total proteins (Nakashima et al., 1990); NAKH900103 AA composition of mt-proteins (Nakashima et al., 1990); NAKH900104 Normalized composition of mt-proteins (Nakashima et al., 1990); NAKH900105 AA composition of mt-proteins from animal (Nakashima et al., 1990); NAKH900106 Normalized composition from animal (Nakashima et al., 1990); NAKH900107 AA composition of mt-proteins from fungi and plant (Nakashima et al., 1990); NAKH900108 Normalized composition from fungi and plant (Nakashima et al., 1990); NAKH900109 AA composition of membrane proteins (Nakashima et al., 1990); NAKH900110 Normalized composition of membrane proteins (Nakashima et al., 1990); NAKH900111 Transmembrane regions of non-mt-proteins (Nakashima et al., 1990); NAKH900112 Transmembrane regions of mt-proteins (Nakashima et al., 1990); NAKH900113 Ratio of average and computed composition (Nakashima et al., 1990); NAKH920101 AA composition of CYT of single-spanning proteins (Nakashima-Nishikawa, 1992); NAKH920102 AA composition of CYT2 of single-spanning proteins (Nakashima-Nishikawa, 1992);

NAKH920103 AA composition of EXT of single-spanning proteins (Nakashima-Nishikawa, 1992); NAKH920104 AA composition of EXT2 of single-spanning proteins (Nakashima-Nishikawa, 1992); NAKH920105 AA composition of MEM of single-spanning proteins (Nakashima-Nishikawa, 1992); NAKH920106 AA composition of CYT of multi-spanning proteins (Nakashima-Nishikawa, 1992); NAKH920107 AA composition of EXT of multi-spanning proteins (Nakashima-Nishikawa, 1992); NAKH920108 AA composition of MEM of multi-spanning proteins (Nakashima-Nishikawa, 1992); NISK800101 8 A contact number (Nishikawa-Ooi, 1980); NISK860101 14 A contact number (Nishikawa-Ooi, 1986); NOZY710101 Transfer energy, organic solvent/water (Nozaki-Tanford, 1971); OOBM770101 Average non-bonded energy per atom (Oobatake-Ooi, 1977); OOBM770102 Short and medium range non-bonded energy per atom (Oobatake-Ooi, 1977); OOBM770103 Long range non-bonded energy per atom (Oobatake-Ooi, 1977) OOBM770104 Average non-bonded energy per residue (Oobatake-Ooi, 1977); OOBM770105 Short and medium range non-bonded energy per residue (Oobatake-Ooi, 1977); OOBM850101 Optimized beta-structure-coil equilibrium constant (Oobatake et al., 1985); OOBM850102 Optimized propensity to form reverse turn (Oobatake et al., 1985); OOBM850103 Optimized transfer energy parameter (Oobatake et al., 1985); OOBM850104 Optimized average non-bonded energy per atom (Oobatake et al., 1985); OOBM850105 Optimized side chain interaction parameter (Oobatake et al., 1985); PALJ810101 Normalized frequency of alpha-helix from LG (Palau et al., 1981); PALJ810102 Normalized frequency of alpha-helix from CF (Palau et al., 1981); PALJ810103 Normalized frequency of beta-sheet from LG (Palau et al., 1981); PALJ810104 Normalized frequency of beta-sheet from CF (Palau et al., 1981); PALJ810105 Normalized frequency of turn from LG (Palau et al., 1981); PALJ810106 Normalized frequency of turn from CF (Palau et al., 1981); PALJ810107 Normalized frequency of alpha-helix in all-alpha class (Palau et al., 1981); PALJ810108 Normalized frequency of alpha-helix in alpha+beta class (Palau et al., 1981); PALJ810109 Normalized frequency of alpha-helix in alpha/beta class (Palau et al., 1981); PALJ810110 Normalized frequency of beta-sheet in all-beta class (Palau et al., 1981); PALJ810111 Normalized frequency of beta-sheet in alpha+beta class (Palau et al., 1981); PALJ810112 Normalized frequency of beta-sheet in alpha/beta class (Palau et al., 1981); PALJ810113 Normalized frequency of turn in all-alpha class (Palau et al., 1981); PALJ810114 Normalized frequency of turn in all-beta class (Palau et al., 1981); PALJ810115 Normalized frequency of turn in alpha+beta class (Palau et al., 1981); PALJ810116 Normalized frequency of turn in alpha/beta class (Palau et al., 1981); PARJ860101 HPLC parameter (Parker et al., 1986); PLIV810101 Partition coefficient (Pliska et al., 1981); PONP800101 Surrounding hydrophobicity in folded form (Ponnuswamy et al., 1980); PONP800102 Average gain in surrounding hydrophobicity (Ponnuswamy et al., 1980); PONP800103 Average gain ratio in surrounding hydrophobicity (Ponnuswamy et al., 1980); PONP800104 Surrounding hydrophobicity in alpha-helix (Ponnuswamy et al., 1980); PONP800105 Surrounding hydrophobicity in beta-sheet (Ponnuswamy et al., 1980); PONP800106 Surrounding hydrophobicity in turn (Ponnuswamy et al., 1980); PONP800107 Accessibility reduction ratio (Ponnuswamy et al., 1980); PONP800108 Average number of surrounding residues (Ponnuswamy et al., 1980); PRAM820101 Intercept in regression analysis (Prabhakaran-Ponnuswamy, 1982); PRAM820102 Slope in regression analysis x1.0E1 (Prabhakaran-Ponnuswamy, 1982); PRAM820103 Correlation coefficient in regression analysis (Prabhakaran-Ponnuswamy, 1982); PRAM900101 Hydrophobicity (Prabhakaran, 1990); PRAM900102 Relative frequency in alpha-helix (Prabhakaran, 1990); PRAM900103 Relative frequency in beta-sheet (Prabhakaran, 1990); PRAM900104 Relative frequency in reverse-turn (Prabhakaran, 1990); PTIO830101 Helix-coil equilibrium constant (Ptitsyn-Finkelstein, 1983); PTIO830102 Beta-coil equilibrium constant (Ptitsyn-Finkelstein, 1983); QIAN880101 Weights for alpha-helix at the window position of −6 (Qian-Sejnowski, 1988); QIAN880102 Weights for alpha-helix at the window position of −5 (Qian-Sejnowski, 1988); QIAN880103 Weights for alpha-helix at the window position of −4 (Qian-Sejnowski, 1988); QIAN880104 Weights for alpha-helix at the window position of −3 (Qian-Sejnowski, 1988); QIAN880105 Weights for alpha-helix at the window position of −2 (Qian-Sejnowski, 1988); QIAN880106 Weights for alpha-helix at the window position of −1 (Qian-Sejnowski, 1988); QIAN880107 Weights for alpha-helix at the window position of 0 (Qian-Sejnowski, 1988); QIAN880108 Weights for alpha-helix at the window position of 1 (Qian-Sejnowski, 1988); QIAN880109 Weights for alpha-helix at the window position of 2 (Qian-Sejnowski, 1988); QIAN880110 Weights for alpha-helix at the window position of 3 (Qian-Sejnowski, 1988); QIAN880111 Weights for alpha-helix at the window position of 4 (Qian-Sejnowski, 1988); QIAN880112 Weights for alpha-helix at the window position of 5 (Qian-Sejnowski, 1988); QIAN880113 Weights for alpha-helix at the window position of 6 (Qian-Sejnowski, 1988); QIAN880114 Weights for beta-sheet at the window position of −6 (Qian-Sejnowski, 1988); QIAN880115 Weights for beta-sheet at the window position of −5 (Qian-Sejnowski, 1988); QIAN880116 Weights for beta-sheet at the window position of −4 (Qian-Sejnowski, 1988); QIAN880117 Weights for beta-sheet at the window position of −3 (Qian-Sejnowski, 1988); QIAN880118 Weights for beta-sheet at the window position of −2 (Qian-Sejnowski, 1988); QIAN880119 Weights for beta-sheet at the window position of −1 (Qian-Sejnowski, 1988); QIAN880120 Weights for beta-sheet at the window position of 0 (Qian-Sejnowski, 1988); QIAN880121 Weights for beta-sheet at the window position of 1 (Qian-Sejnowski, 1988); QIAN880122 Weights for beta-sheet at the window position of 2 (Qian-Sejnowski, 1988); QIAN880123 Weights for beta-sheet at the window position of 3 (Qian-Sejnowski, 1988); QIAN880124 Weights for beta-sheet at the window position of 4 (Qian-Sejnowski, 1988); QIAN880125 Weights for beta-sheet at the window position of 5 (Qian-Sejnowski, 1988); QIAN880126 Weights for beta-sheet at the window position of 6 (Qian-Sejnowski, 1988); QIAN880127 Weights for coil at the window position of −6 (Qian-Sejnowski, 1988); QIAN880128 Weights for coil at the window position of −5 (Qian-Sejnowski, 1988); QIAN880129 Weights for coil at the window position of −4 (Qian-Sejnowski, 1988); QIAN880130 Weights for coil at the window position of −3 (Qian-Sejnowski, 1988); QIAN880131 Weights for coil at the window position of −2 (Qian-Sejnowski, 1988); QIAN880132 Weights for coil at the window position of −1 (Qian-Sejnowski, 1988); QIAN880133 Weights for coil at the window position of 0 (Qian-Sejnowski, 1988); QIAN880134 Weights for coil at the window position of 1 (Qian-Sejnowski, 1988); QIAN880135 Weights for coil at the window position of 2 (Qian-Sejnowski, 1988); QIAN880136 Weights for coil at the window position of 3 (Qian-Sejnowski, 1988); QIAN880137 Weights for coil at the window position of 4 (Qian-Sejnowski, 1988); QIAN880138 Weights for coil at the window position of 5 (Qian-Sejnowski, 1988); QIAN880139

Weights for coil at the window position of 6 (Qian-Sejnowski, 1988); RACS770101 Average reduced distance for C-alpha (Rackovsky-Scheraga, 1977); RACS770102 Average reduced distance for side chain (Rackovsky-Scheraga, 1977); RACS770103 Side chain orientational preference (Rackovsky-Scheraga, 1977); RACS820101 Average relative fractional occurrence in A0(i) (Rackovsky-Scheraga, 1982); RACS820102 Average relative fractional occurrence in AR(i) (Rackovsky-Scheraga, 1982); RACS820103 Average relative fractional occurrence in AL(i) (Rackovsky-Scheraga, 1982); RACS820104 Average relative fractional occurrence in EL(i) (Rackovsky-Scheraga, 1982); RACS820105 Average relative fractional occurrence in E0(i) (Rackovsky-Scheraga, 1982); RACS820106 Average relative fractional occurrence in ER(i) (Rackovsky-Scheraga, 1982); RACS820107 Average relative fractional occurrence in A0(i−1) (Rackovsky-Scheraga, 1982); RACS820108 Average relative fractional occurrence in AR(i−1) (Rackovsky-Scheraga, 1982); RACS820109 Average relative fractional occurrence in AL(i−1) (Rackovsky-Scheraga, 1982); RACS820110 Average relative fractional occurrence in EL(i−1) (Rackovsky-Scheraga, 1982); RACS820111 Average relative fractional occurrence in E0(1-1) (Rackovsky-Scheraga, 1982); RACS820112 Average relative fractional occurrence in ER(i−1) (Rackovsky-Scheraga, 1982); RACS820113 Value of theta(i) (Rackovsky-Scheraga, 1982); RACS820114 Value of theta(i−1) (Rackovsky-Scheraga, 1982); RADA880101 Transfer free energy from chx to wat (Radzicka-Wolfenden, 1988); RADA880102 Transfer free energy from oct to wat (Radzicka-Wolfenden, 1988); RADA880103 Transfer free energy from vap to chx (Radzicka-Wolfenden, 1988); RADA880104 Transfer free energy from chx to oct (Radzicka-Wolfenden, 1988); RADA880105 Transfer free energy from vap to oct (Radzicka-Wolfenden, 1988); RADA880106 Accessible surface area (Radzicka-Wolfenden, 1988); RADA880107 Energy transfer from out to in (95% buried) (Radzicka-Wolfenden, 1988); RADA880108 Mean polarity (Radzicka-Wolfenden, 1988); RICJ880101 Relative preference value at N" (Richardson-Richardson, 1988); RICJ880102 Relative preference value at N' (Richardson-Richardson, 1988); RICJ880103 Relative preference value at N-cap (Richardson-Richardson, 1988); RICJ880104 Relative preference value at N1 (Richardson-Richardson, 1988); RICJ880105 Relative preference value at N2 (Richardson-Richardson, 1988); RICJ880106 Relative preference value at N3 (Richardson-Richardson, 1988); RICJ880107 Relative preference value at N4 (Richardson-Richardson, 1988); RICJ880108 Relative preference value at N5 (Richardson-Richardson, 1988); RICJ880109 Relative preference value at Mid (Richardson-Richardson, 1988); RICJ880110 Relative preference value at C5 (Richardson-Richardson, 1988); RICJ880111 Relative preference value at C4 (Richardson-Richardson, 1988); RICJ880112 Relative preference value at C3 (Richardson-Richardson, 1988); RICJ880113 Relative preference value at C2 (Richardson-Richardson, 1988); RICJ880114 Relative preference value at C1 (Richardson-Richardson, 1988); RICJ880115 Relative preference value at C-cap (Richardson-Richardson, 1988); RICJ880116 Relative preference value at C' (Richardson-Richardson, 1988); RICJ880117 Relative preference value at C" (Richardson-Richardson, 1988); ROBB760101 Information measure for alpha-helix (Robson-Suzuki, 1976); ROBB760102 Information measure for N-terminal helix (Robson-Suzuki, 1976); ROBB760103 Information measure for middle helix (Robson-Suzuki, 1976); ROBB760104 Information measure for C-terminal helix (Robson-Suzuki, 1976); ROBB760105 Information measure for extended (Robson-Suzuki, 1976); ROBB760106 Information measure for pleated-sheet (Robson-Suzuki, 1976); ROBB760107 Information measure for extended without H-bond (Robson-Suzuki, 1976); ROBB760108 Information measure for turn (Robson-Suzuki, 1976); ROBB760109 Information measure for N-terminal turn (Robson-Suzuki, 1976); ROBB760110 Information measure for middle turn (Robson-Suzuki, 1976); ROBB760111 Information measure for C-terminal turn (Robson-Suzuki, 1976); ROBB760112 Information measure for coil (Robson-Suzuki, 1976); ROBB760113 Information measure for loop (Robson-Suzuki, 1976); ROBB790101 Hydration free energy (Robson-Osguthorpe, 1979); ROSG850101 Mean area buried on transfer (Rose et al., 1985); ROSG850102 Mean fractional area loss (Rose et al., 1985); ROSM880101 Side chain hydropathy, uncorrected for solvation (Roseman, 1988); ROSM880102 Side chain hydropathy, corrected for solvation (Roseman, 1988); ROSM880103 Loss of Side chain hydropathy by helix formation (Roseman, 1988); SIMZ760101 Transfer free energy (Simon, 1976), Cited by Charton-Charton (1982); SNEP660101 Principal component I (Sneath, 1966); SNEP660102 Principal component II (Sneath, 1966); SNEP660103 Principal component III (Sneath, 1966); SNEP660104 Principal component IV (Sneath, 1966); SUEM840101 Zimm-Bragg parameter s at 20 C (Sueki et al., 1984); SUEM840102 Zimm-Bragg parameter sigma ×1.0E4 (Sueki et al., 1984); SWER830101 Optimal matching hydrophobicity (Sweet-Eisenberg, 1983); TANS770101 Normalized frequency of alpha-helix (Tanaka-Scheraga, 1977); TANS770102 Normalized frequency of isolated helix (Tanaka-Scheraga, 1977); TANS770103 Normalized frequency of extended structure (Tanaka-Scheraga, 1977); TANS770104 Normalized frequency of chain reversal R (Tanaka-Scheraga, 1977); TANS770105 Normalized frequency of chain reversal S (Tanaka-Scheraga, 1977); TANS770106 Normalized frequency of chain reversal D (Tanaka-Scheraga, 1977); TANS770107 Normalized frequency of left-handed helix (Tanaka-Scheraga, 1977); TANS770108 Normalized frequency of zeta R (Tanaka-Scheraga, 1977); TANS770109 Normalized frequency of coil (Tanaka-Scheraga, 1977) TANS770110 Normalized frequency of chain reversal (Tanaka-Scheraga, 1977); VASM830101 Relative population of conformational state A (Vasquez et al., 1983); VASM830102 Relative population of conformational state C (Vasquez et al., 1983); VASM830103 Relative population of conformational state E (Vasquez et al., 1983); VELV850101 Electron-ion interaction potential (Veljkovic et al., 1985); VENT840101 Bitterness (Venanzi, 1984); VHEG790101 Transfer free energy to lipophilic phase (von Heijne-Blomberg, 1979); WARP780101 Average interactions per side chain atom (Warme-Morgan, 1978); WEBA780101 RF value in high salt chromatography (Weber-Lacey, 1978); WERD780101 Propensity to be buried inside (Wertz-Scheraga, 1978); WERD780102 Free energy change of epsilon(i) to epsilon(ex) (Wertz-Scheraga, 1978); WERD780103 Free energy change of alpha(R1) to alpha(Rh) (Wertz-Scheraga, 1978); WERD780104 Free energy change of epsilon(i) to alpha(Rh) (Wertz-Scheraga, 1978); WOEC730101 Polar requirement (Woese, 1973); WOLR810101 Hydration potential (Wolfenden et al., 1981); WOLS870101 Principal property value z1 (Wold et al., 1987); WOLS870102 Principal property value z2 (Wold et al., 1987); WOLS870103 Principal property value z3 (Wold et al., 1987); YUTK870101 Unfolding Gibbs energy in water, pH7.0 (Yutani et al., 1987); YUTK870102 Unfolding Gibbs energy in water, pH9.0 (Yutani et al., 1987); YUTK870103 Activation Gibbs energy of unfolding, pH7.0 (Yutani et al., 1987); YUTK870104 Activation Gibbs energy of unfolding, pH9.0 (Yutani et al., 1987); ZASB820101 Dependence of partition coefficient on ionic strength (Zaslaysky et al., 1982); ZIMJ680101 Hydrophobicity (Zimmerman et al., 1968); ZIMJ680102 Bulkiness (Zimmerman et al., 1968); ZIMJ680103 Polarity (Zimmerman et al., 1968); ZIMJ680104 Isoelectric point (Zimmerman et al., 1968); ZIMJ680105 RF rank (Zimmerman et al., 1968); AURR980101 Normalized positional residue frequency at helix termini N4'(Aurora-Rose, 1998); AURR980102 Normalized positional residue frequency at helix termini N''' (Aurora-Rose, 1998); AURR980103 Normalized positional residue frequency at helix termini N'' (Aurora-Rose, 1998); AURR980104 Normalized positional residue frequency at helix termini N'(Aurora-Rose, 1998); AURR980105 Normalized positional residue frequency at helix termini Nc (Aurora-Rose, 1998); AURR980106 Normalized positional residue frequency at helix termini N1 (Aurora-Rose, 1998); AURR980107 Normalized positional residue frequency at helix termini N2 (Aurora-Rose, 1998); AURR980108 Normalized positional residue frequency at helix termini N3 (Aurora-Rose, 1998); AURR980109 Normalized positional residue frequency at helix termini N4 (Aurora-Rose, 1998); AURR980110 Normalized positional residue frequency at helix termini N5 (Aurora-Rose, 1998); AURR980111 Normalized positional residue frequency at helix termini C5 (Aurora-Rose, 1998); AURR980112 Normalized positional residue frequency at helix termini C4 (Aurora-Rose, 1998); AURR980113 Normalized positional residue frequency at helix termini C3 (Aurora-Rose, 1998); AURR980114 Normalized positional residue frequency at helix termini C2 (Aurora-Rose, 1998); AURR980115 Normalized positional residue frequency at helix termini C1 (Aurora-Rose, 1998); AURR980116 Normalized positional residue frequency at helix termini Cc (Aurora-Rose, 1998); AURR980117 Normalized positional residue frequency at helix termini C' (Aurora-Rose, 1998); AURR980118 Normalized positional residue frequency at helix termini C'' (Aurora-Rose, 1998); AURR980119 Normalized positional residue frequency at helix termini C''' (Aurora-Rose, 1998); AURR980120 Normalized positional residue frequency at helix termini C4' (Aurora-Rose, 1998); ONEK900101 Delta G values for the peptides extrapolated to 0 M urea (O'Neil-DeGrado, 1990); ONEK900102 Helix formation parameters (delta delta G) (O'Neil-DeGrado, 1990); VINM940101 Normalized flexibility parameters (B-values), average (Vihinen et al., 1994); VINM940102 Normalized flexibility parameters (B-values) for each residue surrounded by none rigid neighbours (Vihinen et al., 1994); VINM940103 Normalized flexibility parameters (B-values) for each residue surrounded by one rigid neighbours (Vihinen et al., 1994); VINM940104 Normalized flexibility parameters (B-values) for each residue surrounded by two rigid neighbours (Vihinen et al., 1994); MUNV940101 Free energy in alpha-helical conformation (Munoz-Serrano, 1994); MUNV940102 Free energy in alpha-helical region (Munoz-Serrano, 1994); MUNV940103 Free energy in beta-strand conformation (Munoz-Serrano, 1994); MUNV940104 Free energy in beta-strand region (Munoz-Serrano, 1994); MUNV940105 Free energy in beta-strand region (Munoz-Serrano, 1994) WIMW960101 Free energies of transfer of AcW1-X-LL peptides from bilayer interface to water (Wimley-White, 1996); KIMC930101 Thermodynamic beta sheet propensity (Kim-Berg, 1993); MONM990101 Turn propensity scale for transmembrane helices (Monne et al., 1999); BLAM930101 Alpha helix propensity of position 44 in T4 lysozyme (Blaber et al., 1993); PARS000101 p-Values of mesophilic proteins based on the distributions of B values (Parthasarathy-Murthy, 2000); PARS000102 p-Values of thermophilic proteins based on the distributions of B values (Parthasarathy-Murthy, 2000); KUMS000101 Distribution of amino acid residues in the 18 non-redundant families of thermophilic proteins (Kumar et al., 2000); KUMS000102 Distribution of amino acid residues in the 18 non-redundant families of mesophilic proteins (Kumar et al., 2000); KUMS000103 Distribution of amino acid residues in the alpha-helices in thermophilic proteins (Kumar et al., 2000); KUMS000104 Distribution of amino acid residues in the alpha-helices in mesophilic proteins (Kumar et al., 2000); TAKK010101 Side-chain contribution to protein stability (kJ/mol) (Takano-Yutani, 2001); FODM020101 Propensity of amino acids within pi-helices (Fodje-Al-Karadaghi, 2002); NADH010101 Hydropathy scale based on self-information values in the two-state model (5% accessibility) (Naderi-Manesh et al., 2001); NADH010102 Hydropathy scale based on self-information values in the two-state model (9% accessibility) (Naderi-Manesh et al., 2001); NADH010103 Hydropathy scale based on self-information values in the two-state model (16% accessibility) (Naderi-Manesh et al., 2001); NADH010104 Hydropathy scale based on self-information values in the two-state model (20% accessibility) (Naderi-Manesh et al., 2001); NADH010105 Hydropathy scale based on self-information values in the two-state model (25% accessibility) (Naderi-Manesh et al., 2001); NADH010106 Hydropathy scale based on self-information values in the two-state model (36% accessibility) (Naderi-Manesh et al., 2001); NADH010107 Hydropathy scale based on self-information values in the two-state model (50% accessibility) (Naderi-Manesh et al., 2001); MONM990201 Averaged turn propensities in a transmembrane helix (Monne et al., 1999); KOEP990101 Alpha-helix propensity derived from designed sequences (Koehl-Levitt, 1999); KOEP990102 Beta-sheet propensity derived from designed sequences (Koehl-Levitt, 1999); CEDJ970101 Composition of amino acids in extracellular proteins (percent) (Cedano et al., 1997); CEDJ970102 Composition of amino acids in anchored proteins (percent) (Cedano et al., 1997); CEDJ970103 Composition of amino acids in membrane proteins (percent) (Cedano et al., 1997); CEDJ970104 Composition of amino acids in intracellular proteins (percent) (Cedano et al., 1997); CEDJ970105 Composition of amino acids in nuclear proteins (percent) (Cedano et al., 1997); FUKS010101 Surface composition of amino acids in intracellular proteins of thermophiles (percent) (Fukuchi-Nishikawa, 2001); FUKS010102 Surface composition of amino acids in intracellular proteins of mesophiles (percent) (Fukuchi-Nishikawa, 2001); FUKS010103 Surface composition of amino acids in extracellular proteins of mesophiles (percent) (Fukuchi-Nishikawa, 2001); FUKS010104 Surface composition of amino acids in nuclear proteins (percent) (Fukuchi-Nishikawa, 2001); FUKS010105 Interior composition of amino acids in intracellular proteins of thermophiles (percent) (Fukuchi-Nishikawa, 2001); FUKS010106 Interior composition of amino acids in intracellular proteins of mesophiles (percent) (Fukuchi-Nishikawa, 2001); FUKS010107 Interior composition of amino acids in extracellular proteins of mesophiles (percent) (Fukuchi-Nishikawa, 2001); FUKS010108 Interior composition of amino acids in nuclear proteins (percent) (Fukuchi-Nishikawa, 2001); FUKS010109 Entire chain composition of amino acids in intracellular proteins of thermophiles (percent) (Fukuchi-Nishikawa, 2001); FUKS010110 Entire chain composition of amino acids in intracellular proteins of mesophiles (percent) (Fukuchi-Nishikawa, 2001); FUKS010111 Entire chain composition of amino acids in extracellular proteins of mesophiles (percent) (Fukuchi-Nishikawa, 2001); FUKS010112

Entire chain composition of amino acids in nuclear proteins (percent) (Fukuchi-Nishikawa, 2001); AVBF000101 Screening coefficients gamma, local (Avbelj, 2000); AVBF000102 Screening coefficients gamma, non-local (Avbelj, 2000); AVBF000103 Slopes tripeptide, FDPB VFF neutral (Avbelj, 2000); AVBF000104 Slopes tripeptides, LDVFF neutral (Avbelj, 2000); AVBF000105 Slopes tripeptide, FDPB VFF noside (Avbelj, 2000); AVBF000106 Slopes tripeptide FDPB VFF all (Avbelj, 2000); AVBF000107 Slopes tripeptide FDPB PARSE neutral (Avbelj, 2000); AVBF000108 Slopes dekapeptide, FDPB VFF neutral (Avbelj, 2000); AVBF000109 Slopes proteins, FDPB VFF neutral (Avbelj, 2000); YANJ020101 Side-chain conformation by gaussian evolutionary method (Yang et al., 2002); MITS020101 Amphiphilicity index (Mitaku et al., 2002); TSAJ990101 Volumes including the crystallographic waters using the ProtOr (Tsai et al., 1999); TSAJ990102 Volumes not including the crystallographic waters using the ProtOr (Tsai et al., 1999); COSI940101 Electron-ion interaction potential values (Cosic, 1994); PONP930101 Hydrophobicity scales (Ponnuswamy, 1993); WILM950101 Hydrophobicity coefficient in RP-HPLC, C18 with 0.1% TFA/MeCN/H2O (Wilce et al. 1995); WILM950102 Hydrophobicity coefficient in RP-HPLC, C8 with 0.1% TFA/MeCN/H2O (Wilce et al. 1995); WILM950103 Hydrophobicity coefficient in RP-HPLC, C4 with 0.1% TFA/MeCN/H2O (Wilce et al. 1995); WILM950104 Hydrophobicity coefficient in RP-HPLC, C18 with 0.1% TFA/2-PrOH/MeCN/H2O (Wilce et al. 1995); KUHL950101 Hydrophilicity scale (Kuhn et al., 1995); GUOD860101 Retention coefficient at pH 2 (Guo et al., 1986); JURD980101 Modified Kyte-Doolittle hydrophobicity scale (Juretic et al., 1998); BASU050101 Interactivity scale obtained from the contact matrix (Bastolla et al., 2005); BASU050102 Interactivity scale obtained by maximizing the mean of correlation coefficient over single-domain globular proteins (Bastolla et al., 2005); BASU050103 Interactivity scale obtained by maximizing the mean of correlation coefficient over pairs of sequences sharing the TIM barrel fold (Bastolla et al., 2005); SUYM030101 Linker propensity index (Suyama-Ohara, 2003); PUNT030101 Knowledge-based membrane-propensity scale from 1D_Helix in MPtopo databases (Punta-Maritan, 2003); PUNT030102 Knowledge-based membrane-propensity scale from 3D_Helix in MPtopo databases (Punta-Maritan, 2003); GEOR030101 Linker propensity from all dataset (George-Heringa, 2003); GEOR030102 Linker propensity from 1-linker dataset (George-Heringa, 2003); GEOR030103 Linker propensity from 2-linker dataset (George-Heringa, 2003); GEOR030104 Linker propensity from 3-linker dataset (George-Heringa, 2003); GEOR030105 Linker propensity from small dataset (linker length is less than six residues) (George-Heringa, 2003); GEOR030106 Linker propensity from medium dataset (linker length is between six and 14 residues) (George-Heringa, 2003); GEOR030107 Linker propensity from long dataset (linker length is greater than 14 residues) (George-Heringa, 2003); GEOR030108 Linker propensity from helical (annotated by DSSP) dataset (George-Heringa, 2003); GEOR030109 Linker propensity from non-helical (annotated by DSSP) dataset (George-Heringa, 2003); ZHOH040101 The stability scale from the knowledge-based atom-atom potential (Zhou-Zhou, 2004); ZHOH040102 The relative stability scale extracted from mutation experiments (Zhou-Zhou, 2004); ZHOH040103 Buriability (Zhou-Zhou, 2004); BAEK050101 Linker index (Bae et al., 2005); HARY940101 Mean volumes of residues buried in protein interiors (Harpaz et al., 1994); PONJ960101 Average volumes of residues (Pontius et al., 1996); DIGM050101 Hydrostatic pressure asymmetry index, PAI (Di Giulio, 2005); WOLR790101 Hydrophobicity index (Wolfenden et al., 1979); OLSK800101 Average internal preferences (Olsen, 1980); KIDA850101 Hydrophobicity-related index (Kidera et al., 1985); GUYH850102 Apparent partition energies calculated from Wertz-Scheraga index (Guy, 1985); GUYH850103 Apparent partition energies calculated from Robson-Osguthorpe index (Guy, 1985); GUYH850104 Apparent partition energies calculated from Janin index (Guy, 1985); GUYH850105 Apparent partition energies calculated from Chothia index (Guy, 1985); ROSM880104 Hydropathies of amino acid side chains, neutral form (Roseman, 1988); ROSM880105 Hydropathies of amino acid side chains, pi-values in pH 7.0 (Roseman, 1988); JACR890101Weights from the IFH scale (Jacobs-White, 1989); COWR900101Hydrophobicity index, 3.0 pH (Cowan-Whittaker, 1990) BLAS910101 Scaled side chain hydrophobicity values (Black-Mould, 1991); CASG920101 Hydrophobicity scale from native protein structures (Casari-Sippl, 1992); CORJ870101 NNEIG index (Cornette et al., 1987); CORJ870102 SWEIG index (Cornette et al., 1987); CORJ870103 PRIFT index (Cornette et al., 1987); CORJ870104 PRILS index (Cornette et al., 1987); CORJ870105 ALTFT index (Cornette et al., 1987) CORJ870106 ALTLS index (Cornette et al., 1987); CORJ870107 TOTFT index (Cornette et al., 1987); CORJ870108 TOTLS index (Cornette et al., 1987); MIYS990101 Relative partition energies derived by the Bethe approximation (Miyazawa-Jernigan, 1999); MIYS990102 Optimized relative partition energies—method A (Miyazawa-Jernigan, 1999); MIYS990103 Optimized relative partition energies—method B (Miyazawa-Jernigan, 1999); MIYS990104 Optimized relative partition energies—method C (Miyazawa-Jernigan, 1999); MIYS990105 Optimized relative partition energies—method D (Miyazawa-Jernigan, 1999); ENGD860101 Hydrophobicity index (Engelman et al., 1986); and FASG890101 Hydrophobicity index (Fasman, 1989)

In some embodiments of the invention, degenerate oligonucleotides are used to synthesize one or more of the TN1, DH, N2, and/or H3-JH segments of the invention. In certain embodiments of the invention, the codon at or near the 5' end of the oligonucleotide encoding the H3-JH segment is a degenerate codon. Such degenerate codons may be the first codon from the 5' end, the second codon from the 5' end, the third codon from the 5' end, the fourth codon from the 5' end, the fifth codon from the 5' end, and/or any combination of the above. In some embodiments of the invention, one or more of the codons at or near the 5' and/or 3' ends of the DH segment are degenerate. Such degenerate codons may be the first codon from the 5' and/or 3' end(s), the second codon from the 5' and/or 3' end(s), the third codons from the 5' and/or 3' end(s), the fourth codon from the 5' and/or 3' end(s), the fifth codon from the 5' and/or 3' end(s), and/or any combination of the above. Degenerate codons used in each of the oligonucleotides encoding the segments may be selected for their ability to optimally recapitulate sequences in a theoretical segment pool and/or CDRH3 reference set.

In some embodiments, the invention provides methods of producing a theoretical segment pool of H3-JH segments, as described in the Examples. Theoretical segment pools generated utilizing NNN triplets, instead of or in addition to the NN doublets described in Example 5 also fall within the scope of the invention, as do synthetic libraries incorporating segments from these theoretical segment pools.

In some embodiments, the invention provides methods of producing a theoretical segment pool of DH segments, as described in the Examples. In particular, for example, the invention provides methods of producing a theoretical segment pool of DH segments described by the PYTHON program of Example 6. Example 6 describes the application of this program to produce the 68K theoretical segment pool (minimum length of DNA sequences after progressive deletions=4 bases; and minimum length of peptide sequences for inclusion in the theoretical segment pool=2). An alternative example is provided wherein the minimum length of the DNA sequences after progressive deletions was one base and the minimum length of the peptide sequence is one amino acid. It is also contemplated that other values could be used for these parameters. For example, the minimum length of the DNA sequences after progressive deletions could be set as 1, 2, 3, 4, 5, 6, 7, 8, 9, 10, 11, 12, 13, 14, or 15, and the minimum length of the peptide sequences in the theoretical segment pool could be set as 1, 2, 3, 4, or 5.

Design of CDRH3 Libraries Using the TN1, DH, N2, and H3-JH Segments

The CDRH3 libraries of the invention comprise TN1, DH, N2, and H3-JH segments. Thus, in certain embodiments of the invention, the overall design of the CDRH3 libraries can be represented by the following formula:

[TN1]-[DH]-[N2]-[H3-JH].

In certain embodiments of the invention, a synthetic CDRH3 repertoire is combined with selected VH chassis sequences and heavy chain constant regions, via homologous recombination. Therefore, in certain embodiments of the invention, it may be desirable to include DNA sequences flanking the 5' and 3' ends of the synthetic CDRH3 libraries, to facilitate homologous recombination between the synthetic CDRH3 libraries and vectors containing the selected chassis and constant regions. In certain embodiments, the vectors also contain a sequence encoding at least a portion of the non-truncated region of the IGHJ gene (i.e., FRM4-JH). Thus, a polynucleotide encoding an N-terminal sequence (e.g., CA(K/R/T)) may be added to the synthetic CDRH3 sequences, wherein the N-terminal polynucleotide is homologous with FRM3 of the chassis, while a polynucleotide encoding a C-terminal sequence (e.g., WG(Q/R/K)G) may be added to the synthetic CDRH3, wherein the C-terminal polynucleotide is homologous with FRM4-JH. Although the sequence WG(Q/R)G is presented in this exemplary embodiment, additional amino acids, C-terminal to this sequence in FRM4-JH may also be included in the polynucleotide encoding the C-terminal sequence. The purpose of the polynucleotides encoding the N-terminal and C-terminal sequences, in this case, is to facilitate homologous recombination, and one of ordinary skill in the art would recognize that these sequences may be longer or shorter than depicted below. Accordingly, in certain embodiments of the invention, the overall design of the CDRH3 repertoire, including the sequences required to facilitate homologous recombination with the selected chassis, can be represented by the following formula (regions homologous with vector underlined):

CA[R/K/T]-[TN1]-[DH]-[N2]-[H3-JH]-[WG(Q/R/K)G] (SEQ ID NO. 8762, SEQ ID NO. 8763, and SEQ ID NO. 8764, respectively).

In some embodiments of the invention, the CDRH3 repertoire can be represented by the following formula, which excludes the T residue presented in the schematic above:

CA[R/K]-[TN1]-[DH]-[N2]-[H3-JH]-[WG(Q/R/K)G] (SEQ ID NO. 8762, SEQ ID NO. 8763, and SEQ ID NO. 8764, respectively).

References describing collections of V, D, and J genes include Scaviner et al., Exp. Clin, Immunogenet., 1999, 16: 243 and Ruiz et al., Exp. Clin. Immunogenet, 1999, 16: 173, each incorporated by reference in its entirety.

Although homologous recombination is one method of producing the libraries of the invention, a person of ordinary skill in the art will readily recognize that other methods of DNA assembly, such as ligation or site-specific recombination, and/or DNA synthesis, can also be used to produce the libraries of the invention.

CDRH3 Lengths

The lengths of the segments may also be varied, for example, to produce libraries with a particular distribution of CDRH3 lengths. In one embodiment of the invention, the H3-JH segments are about 0 to about 10 amino acids in length, the DH segments are about 0 to about 12 amino acids in length, the TN1 segments are about 0 to about 4 amino acids in length, and the N2 segments are about 0 to about 4 amino acids in length. In certain embodiments, the H3-JH segments are at least about 0, 1, 2, 3, 4, 5, 6, 7, 8, 9, and/or 10 amino acids in length. In some embodiments, the DH segments are at least about 0, 1, 2, 3, 4, 5, 6, 7, 8, 9, 10, 11, and/or 12 amino acids in length. In certain embodiments, the TN1 segments are at least about 0, 1, 2, 3, or 4 amino acids in length. In some embodiments, the N2 amino acids are at least about 0, 1, 2, 3, or 4 amino acids in length. In certain embodiments of the invention, the CDRH3 is about 2 to about 35, about 2 to about 28, or about 5 to about 26 amino acids in length. In some embodiments, the CDRH3 is at least about 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, and/or 35 amino acids in length. In some embodiments, the length of any of the segments or CDRH3s of the invention may be less than a particular number of amino acids, where the number of amino acids is defined using any one of the integers provided above for the respective segment or CDRH3. In certain embodiments of the invention, a particular numerical range is defined, using any two of the integers provided above as lower and upper boundaries of the range, inclusive or exclusive. All combinations of the integers provided, which define an upper and lower boundary, are contemplated.

Design of CDRL3 Libraries

The design of CDRL3 libraries, and light chain sequences, is described in detail in U.S. Publication Nos. 2009/0181855 and 2010/0056386, and WO/2009/036379, each of which is incorporated by reference in its entirety, and is therefore only described briefly herein. Libraries described herein are designed according to similar principles, with three important differences, namely that the libraries of the current invention contain (1) variability in CDRL1 and CDRL2; (2) variability in the framework regions; and/or (3) variability in CDRL3 that is designed to produce light chain libraries with CDRL3s that closely resemble human germline-like CDRL3 sequences, as defined above (Table 1).

A CDRL3 library of the invention may be a VKCDR3 library and/or a VλCDR3 library. In certain embodiments of the invention, patterns of occurrence of particular amino acids at defined positions within VL sequences are determined by analyzing data available in public or other databases, for example, the NCBI database (see, for example, WO/2009/036379). In certain embodiments of the invention, these sequences are compared on the basis of identity and assigned to families on the basis of the germline genes from which they are derived. The amino acid composition at each position of the sequence, in each germline family, may then be determined. This process is illustrated in the Examples provided herein.

Light Chains with Framework Variability

In some embodiments, the invention provides a library of light chain variable domains wherein the light chain variable domains are varied at one or more of framework positions 2, 4, 36, 46, 48, 49, and 66. In some embodiments, the invention provides a library of light chain variable domains comprising at least a plurality of light chain variable domains whose amino acid sequences are identical to one another except for substitutions at one or more of positions 2, 4, 36, 46, 48, 49, and 66. In certain embodiments, the invention provides a library of light chain variable domains comprising at least a plurality of light chain variable domains whose amino acid sequences are at least about 70%, 75%, 80%, 85%, 90%, 95%, 96%, 97%, 98%, 99%, and/or 99.5% to any of the light chain variable domain sequences disclosed herein, and further have substitutions at one or more of positions 2, 4, 36, 46, 48, 49, and 66. In some embodiments, the amino acids selected for inclusion in these positions are selected from amongst about the most 2, 3, 4, 5, 6, 7, 8, 9, and/or 10 most frequently occurring amino acids at the corresponding position in a reference set of light chain variable domains.

In some embodiments, the invention provides systems and methods of selecting framework positions to be varied in a light chain variable domain, comprising:
 (i) obtaining a reference set of light chain sequences, wherein the reference set contains light chain sequences with VL segments selected from the group consisting of sequences found in, or encoded by, a single IGVL germline gene and/or sequences found in, or encoded by, allelic variants of the single IGVL germline gene;
 (ii) determining which framework positions within the reference set have a degree of variability that is similar to the degree of variability occurring in one more CDR positions of the sequences in the reference set (e.g., the variability in a framework position is at least about 70%, 80%, 90%, or 95%, 100%, or more of the variability found in a CDR position of the sequences in the reference set);
 (iii) determining the frequency of occurrence of amino acid residues for each of the framework positions identified in (ii);
 (iv) synthesizing light chain variable domain encoding sequences wherein the framework positions identified in (ii) are varied to include the 2, 3, 4, 5, 6, 7, 8, 9, 10, 11, 12, 13, 14, 15, 16, 17, 18, 19, or 20 most frequently occurring amino acid residues (identified in (iii)) at the corresponding position.

One of ordinary skill in the art, reading the present disclosure will appreciate that the present invention provides analogous methods for developing framework variants of heavy chain sequences.

Light Chains with CDR1 and/or CDR2 Variability

In some embodiments, the invention provides a library of light chain variable domains wherein the light chain variable domains are varied at one or more of CDRL1 positions 28, 29, 30, 30A, 30B, 30E, 31, and 32 (Chothia-Lesk numbering scheme; Chothia and Lesk, J. Mol. Biol., 1987, 196: 901). In some embodiments, the invention provides a library of light chain variable domains wherein the light chain variable domains are varied at one or more of CDRL2 positions 50, 51, 53, and 55. In some embodiments, the amino acids selected for inclusion in these CDRL1 and/or CDRL2 positions are selected from amongst about the most 2, 3, 4, 5, 6, 7, 8, 9, 10, 11, 12, 13, 14, 15, 16, 17, 18, 19, and/or 20 most frequently occurring amino acids at the corresponding position in a reference set of light chain variable domains.

In some embodiments, the invention provides systems and methods for selecting CDRL1 and/or CDRL2 positions to be varied in a light chain variable domain, comprising:
 (i) obtaining a reference set of light chain sequences, wherein the reference set contains light chain sequences with VL segments selected from the group consisting of sequences found in, or encoded by, a single IGVL germline gene and sequences found in, or encoded by, allelic variants of the single IGVL germline gene;
 (ii) determining which CDRL1 and/or CDRL2 positions are variable within the reference set;
 (iii) synthesizing light chain variable domain encoding sequences wherein the CDRL1 and/or CDRL2 positions identified in (ii) are varied to include the 2, 3, 4, 5, 6, 7, 8, 9, 10, 11, 12, 13, 14, 15, 16, 17, 18, 19, or 20 most frequently occurring amino acid residues at the corresponding position.

One of ordinary skill in the art, reading the present disclosure will appreciate that the present invention provides analogous methods for developing CDRH2 and/or CDRH2 variants of heavy chain sequences.

Light Chain Sequences

In some embodiments, the invention provides a light chain library comprising one or more of any of the light chain sequences provided herein, for example, the polypeptide sequences of Table 3 and/or Table 4 and/or the polynucleotide sequences of Table 5, Table 6, and/or Table 7. A person of ordinary skill in the art will recognize that not every light chain sequence provided herein is necessary to produce a functional light chain library of the invention. Therefore, in certain embodiments, a light chain library of the invention will contain a subset of the sequences described above. For example, in certain embodiments of the invention, at least about 10, 100, 200, 300, 400, 500, 600, 700, 800, 900, $10^3$, $10^4$, and/or $10^5$ of the light chain polynucleotide and/or polypeptide sequences provided herein are included in a library. In some embodiments, a library of the invention may contain less than a particular number of polynucleotide or polypeptide segments, where the number of segments is defined using any one of the integers provided above for the respective segment. In certain embodiments of the invention, a particular numerical range is defined, using any two of the integers provided above as lower and upper boundaries of the range, inclusive or exclusive. All combinations of the integers provided, which define an upper and lower boundary, are contemplated.

In certain embodiments, the invention provides light chain libraries comprising at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the sequences from any of the sets of light chain sequences provided herein. For example, the invention provides libraries comprising at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the light chain sequences provided in Table 3, Table 4, Table 5, Table 6, and/or Table 7. In some embodiments of the invention, a particular percentage range is defined, using any two of the percentages provided above as lower and upper boundaries of the range, inclusive or exclusive. All combinations of the percentages provided, which define an upper and lower boundary, are contemplated.

In some embodiments of the invention, at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the light chain sequences in a library are light chain sequences provided herein. In certain embodiments of the invention, at least about 1%, 2.5%, 5%, 10%, 15%, 20%, 25%, 30%, 40%, 45%, 50%, 55%, 60%, 65%, 70%, 75%, 80%, 85%, 90%, 95%, or 99% of the light chain sequences isolated from a light chain library (e.g., by binding to a particular antigen and/or generic ligand) are light chain sequences provided herein. In some embodiments, a light chain library of the invention may contain less than a particular percentage of light chain sequences provided herein, where the percentage of light chain sequences is defined using any one of the percentages provided above. In certain embodiments of the invention, a particular percentage range is defined, using any two of the percentages provided above as lower and upper boundaries of the range, inclusive or exclusive. All combinations of the percentages provided, which define an upper and lower boundary, are contemplated.

One of ordinary skill in the art will further recognize that given the light chain sequences provided herein, similar light chain sequences could be produced which share a designated level of overall sequence identity and/or one or more characteristic sequence elements described herein, which overall degree of sequence identity and/or characteristic sequence elements may confer common functional attributes. Those of ordinary skill in the art will be well familiar with a variety of techniques for preparing such related sequences, including the mutagenesis techniques provided herein. Therefore, each of the explicitly enumerated embodiments of the invention can also be practiced using light chain sequences that share a particular percent identity to any of the light chain sequences provided herein. For example, each of the previously described embodiments of the invention can be practiced using light chain sequences that are at least about 70%, 75%, 80%, 85%, 90%, 91%, 92%, 93%, 94%, 95%, 96%, 97%, 98%, 99%, 99.5%, or 99.9% identical to the light chain sequences provided herein. For example, in some embodiments, light chain libraries provided by the invention comprise light chain variable domains at least about 70%, 75%, 80%, 85%, 90%, 91%, 92%, 93%, 94%, 95%, 96%, 97%, 98%, 99%, 99.5%, or 99.9% identical to the light chain sequences provided herein, with substitutions in one or more of framework positions 2, 4, 36, 46, 48, 49, and 66, CDRL1 positions 28, 29, 30, 30A, 30B, 30E, 31, and 32 (Chothia-Lesk numbering scheme), and/or CDRL2 positions 50, 51, 53, and 55.

In some embodiments, the invention provides systems and methods for varying positions within the portion of CDRL3s encoded by a particular IGVL germline gene, comprising:
 (i) obtaining a reference set of light chain sequences, wherein the reference set contains light chain sequences with VL segments originating from the same IGVL germline gene and/or its allelic variants;
 (ii) determining which amino acids occur at each of the CDRL3 positions in the reference set that are encoded by the IGVL gene (i.e., positions 89-94, inclusive);
 (iii) synthesizing light chain variable domain encoding sequences wherein two positions in each light chain variable domain encoding sequence contain degenerate codons encoding the 2, 3, 4, 5, 6, 7, 8, 9, 10, 11, 12, 13, 14, 15, 16, 17, 18, 19, or 20 most frequently occurring amino acid residues at the corresponding positions in the reference set.

As described in the examples, the degenerate codons of (iii) can be chosen to best reproduce the amino acid diversity contained in the reference set for each of the two positions varied in each light chain. Finally, while the methods and systems described above are described with respect to CDRL3, one of ordinary skill in the art will readily recognize that the same principles can be applied to CDRH1 and/or CDRH2 of the heavy chain, which are encoded entirely by the IGHV gene.

CDRL3 Lengths

In some embodiments, as an alternative or in addition to other features described herein, the present invention provides libraries in which lengths of CDRL3s may be varied. The present invention therefore provides, among other things, libraries with a particular distribution of CDRL3 lengths. Although CDRL3 libraries of lengths 8, 9, and 10 are exemplified, one of ordinary skill in the art will readily recognize that the methods described herein can be applied to produce light chains with CDRL3s of different lengths (e.g., about 5, 6, 7, 11, 12, 13, 14, 15, and/or 16) that also fall within the scope of the invention. In some embodiments, the length of any of the CDRL3s of the invention may be less than a particular number of amino acids, where the number of amino acids is defined using any one of the integers provided above. In some embodiments of the invention, a particular numerical range is defined, using any two of the integers provided above as lower and upper boundaries of the range, inclusive or exclusive. All combinations of the integers provided, which define an upper and lower boundary, are contemplated.

Synthetic Antibody Libraries

In some embodiments of the invention, provided libraries include one or more synthetic polynucleotides. In some embodiments, provided libraries may comprise synthetic polynucleotides selected from (a) heavy chain chassis polynucleotides; (b) light chain chassis polynucleotides; (c) CDR3 polynucleotides; (d) constant domain polynucleotides; and (e) combinations thereof. Those of ordinary skill in the art will appreciate that such synthetic polynucleotides may be linked to other synthetic or non-synthetic polynucleotides in provided libraries.

Synthetic polynucleotides provided herein may be prepared by any available method. For example, in some embodiments, synthetic polynucleotides can be synthesized by split pool DNA synthesis as described in Feldhaus et al., Nucleic Acids Research, 2000, 28: 534; Omstein et al., Biopolymers, 1978, 17: 2341; Brenner and Lerner, PNAS, 1992, 87: 6378, U.S. Publication Nos. 2009/0181855 and 2010/0056386, and WO/2009/036379 (each incorporated by reference in its entirety).

In some embodiments of the invention, segments representing the possible TN1, DH, N2, and JH diversity found in the human repertoire are synthesized de novo either as double-stranded DNA oligonucleotides, single-stranded DNA oligonucleotides representative of the coding strand, or single-stranded DNA oligonucleotides representative of the non-coding strand. Such sequences can then be introduced into a host cell along with an acceptor vector containing a chassis sequence and, in some cases a portion of FRM4 and a constant region. No primer-based PCR amplification from mammalian cDNA or mRNA or template-directed cloning steps from mammalian cDNA or mRNA need be employed.

Construction of Libraries by Yeast Homologous Recombination

In certain embodiments, the invention exploits the inherent ability of yeast cells to facilitate homologous recombination at high efficiency. The mechanism of homologous recombination in yeast and its applications are briefly described below (also see e.g., U.S. Pat. Nos. 6,406,863; 6,410,246; 6,410,271; 6,610,472; and 7,700,302, each of which is incorporated by reference in its entirety).

As an illustrative embodiment, homologous recombination can be carried out in, for example, *Saccharomyces cerevisiae*, which has genetic machinery designed to carry out homologous recombination with high efficiency. Exemplary *S. cerevisiae* strains include EM93, CEN.PK2, RM11-1a, YJM789, and BJ5465. This mechanism is believed to have evolved for the purpose of chromosomal repair, and is also called "gap repair" or "gap filling". By exploiting this mechanism, mutations can be introduced into specific loci of the yeast genome. For example, a vector carrying a mutant gene can contain two sequence segments that are homologous to the 5' and 3' open reading frame (ORF) sequences of a gene that is intended to be interrupted or mutated. The vector may also encode a positive selection marker, such as a nutritional enzyme allele (e.g., URA3) and/or an antibiotic resistant marker (e.g., Geneticin/G418), flanked by the two homologous DNA segments. Other selection markers and antibiotic resistance markers are known to one of ordinary skill in the art.

In some embodiments of the invention, this vector (e.g., a plasmid) is linearized and transformed into the yeast cells. Through homologous recombination between the plasmid and the yeast genome, at the two homologous recombination sites, a reciprocal exchange of the DNA content occurs between the wild type gene in the yeast genome and the mutant gene (including the selection marker gene(s)) that is flanked by the two homologous sequence segments. By selecting for the one or more selection markers, the surviving yeast cells will be those cells in which the wild-type gene has been replaced by the mutant gene (Pearson et al., Yeast, 1998, 14: 391, incorporated by reference in its entirety). This mechanism has been used to make systematic mutations in all 6,000 yeast genes, or open reading frames (ORFs), for functional genomics studies. Because the exchange is reciprocal, a similar approach has also been used successfully to clone yeast genomic DNA fragments into a plasmid vector (Iwasaki et al., Gene, 1991, 109: 81, incorporated by reference in its entirety).

By utilizing the endogenous homologous recombination machinery present in yeast, gene fragments or synthetic oligonucleotides can also be cloned into a plasmid vector without a ligation step. In this application of homologous recombination, a target gene fragment (i.e., the fragment to be inserted into a plasmid vector, e.g., a CDR3) is obtained (e.g., by oligonucleotides synthesis, PCR amplification, restriction digestion out of another vector, etc.). DNA sequences that are homologous to selected regions of the plasmid vector are added to the 5' and 3' ends of the target gene fragment. These homologous regions may be fully synthetic, or added via PCR amplification of a target gene fragment with primers that incorporate the homologous sequences. The plasmid vector may include a positive selection marker, such as a nutritional enzyme allele (e.g., URA3), or an antibiotic resistance marker (e.g., Geneticin/G418). The plasmid vector is then linearized by a unique restriction cut located in-between the regions of sequence homology shared with the target gene fragment, thereby creating an artificial gap at the cleavage site. The linearized plasmid vector and the target gene fragment flanked by sequences homologous to the plasmid vector are co-transformed into a yeast host strain. The yeast is then able to recognize the two stretches of sequence homology between the vector and target gene fragment and facilitate a reciprocal exchange of DNA content through homologous recombination at the gap. As a consequence, the target gene fragment is inserted into the vector without ligation.

The method described above has also been demonstrated to work when the target gene fragments are in the form of single stranded DNA, for example, as a circular M13 phage derived form, or as single stranded oligonucleotides (Simon and Moore, Mol. Cell. Biol., 1987, 7: 2329; Ivanov et al., Genetics, 1996, 142: 693; and DeMarini et al., 2001, 30: 520., each incorporated by reference in its entirety). Thus, the form of the target that can be recombined into the gapped vector can be double stranded or single stranded, and derived from chemical synthesis, PCR, restriction digestion, or other methods.

Several factors may influence the efficiency of homologous recombination in yeast. For example, the efficiency of the gap repair is correlated with the length of the homologous sequences flanking both the linearized vector and the target gene. In certain embodiments, about 20 or more base pairs may be used for the length of the homologous sequence, and about 80 base pairs may give a near-optimized result (Hua et al., Plasmid, 1997, 38: 91; Raymond et al., Genome Res., 2002, 12: 190, each incorporated by reference in its entirety). In certain embodiments of the invention, at least about 5, 10, 15, 20, 21, 22, 23, 24, 25, 26, 27, 28, 29, 30, 31, 32, 33, 34 35, 36, 37, 38, 39, 40, 45, 50, 55, 60, 65, 70, 75, 80, 85, 90, 95, 100, 110, 120, 130, 140, 150, 160, 170, 180, 187, 190, or 200 homologous base pairs may be used to facilitate recombination. In certain embodiments, between about 20 and about 40 base pairs are utilized. In addition, the reciprocal exchange between the vector and gene fragment is strictly sequence-dependent, i.e. it does not cause a frame shift. Therefore, gap-repair cloning assures the insertion of gene fragments with both high efficiency and precision. The high efficiency makes it possible to clone two, three, or more targeted gene fragments simultaneously into the same vector in one transformation attempt (Raymond et al., Biotechniques, 1999, 26: 134, incorporated by reference in its entirety). Moreover, the nature of precision sequence conservation through homologous recombination makes it possible to clone selected genes or gene fragments into expression or fusion vectors for direct functional examination (El-Deiry et al., Nature Genetics, 1992, 1: 4549; Ishioka et al., PNAS, 1997, 94: 2449, each incorporated by reference in its entirety).

Libraries of gene fragments have also been constructed in yeast using homologous recombination. For example, a human brain cDNA library was constructed as a two-hybrid fusion library in vector pJG4-5 (Guidotti and Zervos, Yeast, 1999, 15: 715, incorporated by reference in its entirety). It has also been reported that a total of 6,000 pairs of PCR primers were used for amplification of 6,000 known yeast ORFs for a study of yeast genomic protein interactions (Hudson et al., Genome Res., 1997, 7: 1169, incorporated by reference in its entirety). In 2000, Uetz et al. conducted a comprehensive analysis-of protein-protein interactions in *Saccharomyces cerevisiae* (Uetz et al., Nature, 2000, 403: 623, incorporated by reference in its entirety). The protein-protein interaction map of the budding yeast was studied by using a comprehensive system to examine two-hybrid interactions in all possible combinations between the yeast proteins (Ito et al., PNAS, 2000, 97: 1143, incorporated by reference in its entirety), and the genomic protein linkage map of Vaccinia virus was studied using this system (McCraith et al., PNAS, 2000, 97: 4879, incorporated by reference in its entirety).

In certain embodiments of the invention, a synthetic CDR3 (heavy or light chain) may be joined by homologous recombination with a vector encoding a heavy or light chain chassis, a portion of FRM4, and a constant region, to form a full-length heavy or light chain. In certain embodiments of the invention, the homologous recombination is performed directly in yeast cells. In some embodiments, such a method comprises:

(a) transforming into yeast cells:
  (i) a linearized vector encoding a heavy or light chain chassis, a portion of FRM4, and a constant region, wherein the site of linearization is between the end of FRM3 of the chassis and the beginning of the constant region; and (ii) a library of CDR3 insert nucleotide sequences that are linear and double stranded, wherein each of the CDR3 insert sequences comprises a nucleotide sequence encoding CDR3 and 5'- and 3'-flanking sequences that are sufficiently homologous to the termini of the vector of (i) at the site of linearization to enable homologous recombination to occur between the vector and the library of CDR3 insert sequences; and (b) allowing homologous recombination to occur between the vector and the CDR3 insert sequences in the transformed yeast cells, such that the CDR3 insert sequences are incorporated into the vector, to produce a vector encoding full-length heavy chain or light chain.

As specified above, CDR3 inserts may have a 5' flanking sequence and a 3' flanking sequence that are homologous to the termini of the linearized vector. When the CDR3 inserts and the linearized vectors are introduced into a host cell, for example, a yeast cell, the "gap" (the linearization site) created by linearization of the vector is filled by the CDR3 fragment insert through recombination of the homologous sequences at the 5' and 3' termini of these two linear double-stranded DNAs (i.e., the vector and the insert). Through this event of homologous recombination, libraries of circular vectors encoding full-length heavy or light chains comprising variable CDR3 inserts is generated. Particular instances of these methods are presented in the Examples.

Subsequent analysis may be carried out to determine, for example, the efficiency of homologous recombination that results in correct insertion of the CDR3 sequences into the vectors. For example, PCR amplification of the CDR3 inserts directly from selected yeast clones may reveal how many clones are recombinant. In certain embodiments, libraries with minimum of about 90% recombinant clones are utilized. In certain embodiments libraries with a minimum of about 1%, 5% 10%, 15%, 20%, 25%, 30%, 35%, 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, or 99% recombinant clones are utilized. The same PCR amplification of selected clones may also reveal the insert size.

To verify the sequence diversity of the inserts in the selected clones, a PCR amplification product with the correct size of insert may be "fingerprinted" with restriction enzymes known to cut or not cut within the amplified region. From a gel electrophoresis pattern, it may be determined whether the clones analyzed are of the same identity or of the distinct or diversified identity. The PCR products may also be sequenced directly to reveal the identity of inserts and the fidelity of the cloning procedure, and to prove the independence and diversity of the clones.

Expression and Screening Systems

Libraries of polynucleotides generated by any of the techniques described herein, or other suitable techniques, can be expressed and screened to identify antibodies having desired structure and/or activity. Expression of the antibodies can be carried out, for example, using cell-free extracts (and e.g., ribosome display), phage display, prokaryotic cells (e.g., bacterial display), or eukaryotic cells (e.g., yeast display). In certain embodiments of the invention, the antibody libraries are expressed in yeast.

In some embodiments, polynucleotides are engineered to serve as templates that can be expressed in a cell-free extract. Vectors and extracts as described, for example in U.S. Pat. Nos. 5,324,637; 5,492,817; 5,665,563, (each incorporated by reference in its entirety) can be used and many are commercially available. Ribosome display and other cell-free techniques for linking a polynucleotide (i.e., a genotype) to a polypeptide (i.e., a phenotype) can be used, e.g., Profusion™ (see, e.g., U.S. Pat. Nos. 6,348,315; 6,261,804; 6,258,558; and 6,214,553, each incorporated by reference in its entirety).

Alternatively or additionally, polynucleotides of the invention can be expressed in an *E. coli* expression system, such as that described by Pluckthun and Skerra. (Meth. Enzymol., 1989, 178: 476; Biotechnology, 1991, 9: 273, each incorporated by reference in its entirety). Mutant proteins can be expressed for secretion in the medium and/or in the cytoplasm of the bacteria, as described by Better and Horwitz, Meth. Enzymol., 1989, 178: 476, incorporated by reference in its entirety. In some embodiments, the single domains encoding VH and VL are each attached to the 3' end of a sequence encoding a signal sequence, such as the ompA, phoA or pelB signal sequence (Lei et al., J. Bacteriol., 1987, 169: 4379, incorporated by reference in its entirety). These gene fusions are assembled in a dicistronic construct, so that they can be expressed from a single vector, and secreted into the periplasmic space of *E. coli* where they will refold and can be recovered in active form. (Skerra et al., Biotechnology, 1991, 9: 273, incorporated by reference in its entirety). For example, antibody heavy chain genes can be concurrently expressed with antibody light chain genes to produce antibodies or antibody fragments.

In some embodiments of the invention, antibody sequences are expressed on the membrane surface of a prokaryote, e.g., *E. coli*, using a secretion signal and lipidation moiety as described, e.g., in US2004/0072740; US2003/0100023; and US2003/0036092 (each incorporated by reference in its entirety).

Higher eukaryotic cells, such as mammalian cells, for example myeloma cells (e.g., NS/0 cells), hybridoma cells, Chinese hamster ovary (CHO), and human embryonic kidney (HEK) cells, can also be used for expression of the antibodies of the invention. Typically, antibodies expressed in mammalian cells are designed to be secreted into the culture medium, or expressed on the surface of the cell. Antibody or antibody fragments can be produced, for example, as intact antibody molecules or as individual VH and VL fragments, Fab fragments, single domains, or as single chains (scFv) (Huston et al., PNAS, 1988, 85: 5879, incorporated by reference in its entirety).

Alternatively or additionally, antibodies can be expressed and screened by anchored periplasmic expression (APEx 2-hybrid surface display), as described, for example, in Jeong et al., PNAS, 2007, 104: 8247 (incorporated by reference in its entirety) or by other anchoring methods as described, for example, in Mazor et al., Nature Biotechnology, 2007, 25: 563 (incorporated by reference in its entirety).

In some embodiments of the invention, antibodies can be selected using mammalian cell display (Ho et al., PNAS, 2006, 103: 9637, incorporated by reference in its entirety).

Screening of the antibodies derived from the libraries of the invention can be carried out by any appropriate means. For example, binding activity can be evaluated by standard immunoassay and/or affinity chromatography. Screening of antibodies of the invention for catalytic function, e.g., proteolytic function can be accomplished using a standard assays, e.g., the hemoglobin plaque assay as described in U.S. Pat. No. 5,798,208 (incorporated by reference in its entirety). Determining the ability of candidate antibodies to bind therapeutic targets can be assayed in vitro using, e.g., a BIACORE™ instrument, which measures binding rates of an antibody to a given target or antigen based on surface plasmon resonance. In vivo assays can be conducted using any of a number of animal models and then subsequently tested, as appropriate, in humans. Cell-based biological assays are also contemplated.

One feature of the instant invention is the speed at which the antibodies of the library can be expressed and screened. In certain embodiments of the invention, the antibody library can be expressed in yeast, which have a doubling time of less than about 3, 4, 5, 6, 7, 8, 9, 10, 11, 12, 13, 14, 15, 16, 17, 18, 19, 20, 21, 22, 23, or 24 hours. In some embodiments, the doubling times are about 1 to about 3 hours, about 2 to about 4, about 3 to about 8 hours, about 3 to about 24, about 5 to about 24, about 4 to about 6 about 5 to about 22, about 6 to about 8, about 7 to about 22, about 8 to about 10 hours, about 7 to about 20, about 9 to about 20, about 9 to about 18, about 11 to about 18, about 11 to about 16, about 13 to about 16, about 16 to about 20, or about 20 to about 30 hours. In certain embodiments of the invention, an antibody library is expressed in yeast with a doubling time of about 16 to about 20 hours, about 8 to about 16 hours, or about 4 to about 8 hours. Thus, an antibody library of the instant invention can be expressed and screened in a matter of hours, as compared to previously known techniques which take several days to express and screen antibody libraries. A limiting step in the throughput of such screening processes in mammalian cells is typically the time required to iteratively regrow populations of isolated cells, which, in some cases, have doubling times greater than the doubling times of the yeast used in the current invention.

In certain embodiments of the invention, the composition of a library may be defined after one or more enrichment steps (for example by screening for antigen binding, binding to a generic ligand, or other properties). For example, a library with a composition comprising about x% sequences or libraries of the invention may be enriched to contain about 2x%, 3x%, 4x%, 5x%, 6x%, 7x%, 8x%, 9x%, 10x%, 20x%, 25x%, 40x%, 50x%, 60x% 75x%, 80x%, 90x%, 95x%, or 99x% sequences or libraries of the invention, after one or more screening steps. In some embodiments of the invention, the sequences or libraries of the invention may be enriched about 2-fold, 3-fold, 4-fold, 5-fold, 6-fold, 7-fold, 8-fold, 9-fold, 10-fold, 100-fold, 1,000-fold, or more, relative to their occurrence prior to the one or more enrichment steps. In certain embodiments of the invention, a library may contain at least a certain number of a particular type of sequence(s), such as CDRH3s, CDRL3s, heavy chains, light chains, or whole antibodies (e.g., at least about $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, or $10^{20}$). In certain embodiments, these sequences may be enriched during one or more enrichment steps, to provide libraries comprising at least about $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, or $10^{19}$ of the respective sequence(s).

Mutagenesis Approaches for Affinity Maturation

As described above, antibody leads can be identified through a selection process that involves screening the antibodies of a library of the invention for binding to one or more antigens, or for a biological activity. Coding sequences of these antibody leads may be further mutagenized in vitro or in vivo to generate secondary libraries with diversity introduced in the context of the initial antibody leads. Such mutagenized antibody leads can then be further screened for binding to target antigens or biological activity, in vitro or in vivo, following procedures similar to those used for the selection of the initial antibody lead from the primary library. Such mutagenesis and selection of primary antibody leads effectively mimics the affinity maturation process naturally occurring in a mammal that produces antibodies with progressive increases in the affinity to an antigen.

In some embodiments of the invention, only the CDRH3 region is mutagenized. In some embodiments of the invention, the whole variable region is mutagenized. In some embodiments of the invention one or more of CDRH1, CDRH2, CDRH3, CDRL1, CDRL2, and/CDRL3 may be mutagenized. In some embodiments of the invention, "light chain shuffling" may be used as part of the affinity maturation protocol. In certain embodiments, this may involve pairing one or more heavy chains with a number of light chains, to select light chains that enhance the affinity and/or biological activity of an antibody. In certain embodiments of the invention, the number of light chains to which the one or more heavy chains can be paired is at least about 2, 5, 10, 100, $10^3$, $10^4$, $10^5$, $10^6$, $10^7$, $10^8$, $10^9$, or $10^{10}$. In certain embodiments of the invention, these light chains are encoded by plasmids. In some embodiments of the invention, the light chains may be integrated into the genome of the host cell.

Coding sequences of antibody leads may be mutagenized using any of wide variety of methods. Examples of methods of mutagenesis include, but are not limited to site-directed mutagenesis, error-prone PCR mutagenesis, cassette mutagenesis, and random PCR mutagenesis. Alternatively or additionally, oligonucleotides encoding regions with the desired mutations can be synthesized and introduced into the sequence to be mutagenized, for example, via recombination or ligation.

Site-directed mutagenesis or point mutagenesis may be used to gradually change the CDR sequences in specific regions. For example, this may be accomplished by using oligonucleotide-directed mutagenesis or PCR. For example, a short sequence of an antibody lead may be replaced with a synthetically mutagenized oligonucleotide in either the heavy chain or light chain region, or both. Such a method may not be efficient for mutagenizing large numbers of CDR sequences, but may be used for fine tuning of a particular lead to achieve higher affinity toward a specific target protein.

Cassette mutagenesis may alternatively or additionally be used to mutagenize the CDR sequences in specific regions. In a typical cassette mutagenesis, a sequence block, or a region, of a single template is replaced by a completely or partially randomized sequence. However, the maximum information content that can be obtained may be statistically limited by the number of random sequences of the oligonucleotides. Similar to point mutagenesis, this method may also be used for fine tuning of a particular lead to achieve higher affinity towards a specific target protein.

Error-prone PCR, or "poison" PCR, may be used to mutagenize the CDR sequences, for example, by following protocols described in U.S. Pat. No. 6,153,745; Caldwell and Joyce, PCR Methods and Applications, 1992, 2: 28; Leung et al., Technique, 1989, 1: 11; Shafikhani et al., Biotechniques, 1997, 23: 304; and Stemmer et al., PNAS, 1994, 91: 10747 (each of which is incorporated by reference in its entirety).

Conditions for error prone PCR may include, for example, (a) high concentrations of $Mn^2$ (e.g., about 0.4 to about 0.6 mM) that efficiently induces malfunction of Taq DNA polymerase; and/or (b) a disproportionally high concentration of one nucleotide substrate (e.g., dGTP) in the PCR reaction that causes incorrect incorporation of this high concentration substrate into the template and produces mutations. Alternatively or additionally, other factors such as, the number of PCR cycles, the species of DNA polymerase used, and the length of the template, may affect the rate of misincorporation of "wrong" nucleotides into the PCR product. Commercially available kits may be utilized for the mutagenesis of the selected antibody library, such as the "Diversity PCR random mutagenesis kit" (CLONTECH™).

Primer pairs used in PCR-based mutagenesis may, in certain embodiments, include regions matched with the homologous recombination sites in the expression vectors. Such a design allows facile re-introduction of the PCR products back into the heavy or light chain chassis vectors, after mutagenesis, via homologous recombination.

Other PCR-based mutagenesis methods can also be used, alone or in conjunction with the error prone PCR described above. For example, the PCR amplified CDR segments may be digested with DNase to create nicks in the double stranded DNA. These nicks can be expanded into gaps by other exonucleases such as Bal 31. Gaps may then be filled by random sequences by using DNA Klenow polymerase at a low concentration of regular substrates dGTP, dATP, dTTP, and dCTP with one substrate (e.g., dGTP) at a disproportionately high concentration. This fill-in reaction should produce high frequency mutations in the filled gap regions. Such methods of DNase digestion may be used in conjunction with error prone PCR to create a high frequency of mutations in the desired CDR segments.

CDR or antibody segments amplified from the primary antibody leads may also be mutagenized in vivo by exploiting the inherent ability of mutation in pre-B cells. The Ig genes in pre-B cells are specifically susceptible to a high-rate of mutation. The Ig promoter and enhancer facilitate such high rate mutations in a pre-B cell environment while the pre-B cells proliferate. Accordingly, CDR gene segments may be cloned into a mammalian expression vector that contains a human Ig enhancer and promoter. Such a construct may be introduced into a pre-B cell line, such as 38B9, which allows the mutation of the VH and VL gene segments naturally in the pre-B cells (Liu and Van Ness, Mol. Immunol., 1999, 36: 461, incorporated by reference in its entirety). The mutagenized CDR segments can be amplified from the cultured pre-B cell line and re-introduced back into the chassis-containing vector(s) via, for example, homologous recombination.

In some embodiments, a CDR "hit" isolated from screening the library can be re-synthesized, for example using degenerate codons or trinucleotides, and re-cloned into the heavy or light chain vector using gap repair.

Other Variants of Polynucleotide Sequences of the Invention

In certain embodiments, the invention provides a polynucleotide that hybridizes with a polynucleotide taught herein, or that hybridizes with the complement of a polynucleotide taught herein. For example, an isolated polynucleotide that remains hybridized after hybridization and washing under low, medium, or high stringency conditions to a polynucleotide taught herein or the complement of a polynucleotide taught herein is encompassed by the present invention.

Exemplary low stringency conditions include hybridization with a buffer solution of about 30% to about 35% formamide, about 1 M NaCl, about 1% SDS (sodium dodecyl sulphate) at about 37° C., and a wash in about 1× to about 2×SSC (20×SSC=3.0 M NaCl/0.3 M trisodium citrate) at about 50° C. to about 55° C.

Exemplary moderate stringency conditions include hybridization in about 40% to about 45% formamide, about 1 M NaCl, about 1% SDS at about 37° C., and a wash in about 0.5× to about 1×SSC at abut 55° C. to about 60° C.

Exemplary high stringency conditions include hybridization in about 50% formamide, about 1 M NaCl, about 1% SDS at about 37° C., and a wash in about 0.1×SSC at about 60° C. to about 65° C.

Optionally, wash buffers may comprise about 0.1% to about 1% SDS.

The duration of hybridization is generally less than about 24 hours, usually about 4 to about 12 hours.

Sublibraries and Larger Libraries Comprising Libraries or Sub-Libraries of the Invention Libraries comprising combinations of the libraries described herein (e.g., CDRH3 and CDRL3 libraries) are encompassed by the invention. Sublibraries comprising portions of the libraries described herein are also encompassed by the invention (e.g., a CDRH3 library in a particular heavy chain chassis or a sub-set of the CDRH3 libraries, for example based on length).

Moreover, libraries containing one of the libraries or sublibraries of the invention also fall within the scope of the invention. For example, in certain embodiments of the invention, one or more libraries or sublibraries of the invention may be contained within a larger library (theoretical or physical), which may include sequences derived by other means, for example, non-human or human sequence derived by stochastic or sitewise-stochastic synthesis. In certain embodiments of the invention, at least about 1% of the sequences in a polynucleotide library may be those of the invention (e.g., CDRH3 sequences, CDRL3 sequences, VH sequences, VL sequences), regardless of the composition of the other 99% of sequences. For the purposes of illustration only, one of ordinary skill in the art would readily recognize that a library containing $10^9$ total members, where $10^7$ members are members of the libraries of the invention (i.e., 1%) would have utility, and that members of the libraries of the invention could be isolated from such a library. In some embodiments of the invention, at least about 0.001%, 0.01%, 0.1%, 2%, 5%, 10%, 20%, 30%, 40%, 50%, 60%, 70%, 80%, 81%, 82%, 83%, 84%, 85%, 86%, 87%, 88%, 89%, 90%, 91,%, 92%, 93%, 94%, 95%, 96%, 97%, 98% or 99% of the sequences in any polynucleotide library may be those of the invention, regardless of the composition of the other sequences. In some embodiments, the sequences of the invention may comprise about 0.001% to about 1%, about 1% to about 2%, about 2% to about 5%, about 5% to about 10%, about 10% to about 15%, about 15% to about 20%, about 20% to about 25%, about 25% to about 30%, about 30% to about 35%, about 35% to about 40%, about 40% to about 45%, about 45% to about 50%, about 50% to about 55%, about 55% to about 60%, about 60% to about 65%, about 65% to about 70%, about 70% to about 75%, about 75% to about 80%, about 80% to about 85%, about 85% to about 90%, about 90% to about 95%, or about 95% to about 99% of the sequences in any polynucleotide library, regardless of the composition of the other sequences. Thus, libraries more diverse than one or more libraries or sublibraries of the invention, but yet still comprising one or more libraries or sublibraries of the invention, in an amount in which the one or more libraries or sublibraries of the invention can be effectively screened and from which sequences encoded by the one or more libraries or sublibraries of the invention can be isolated, also fall within the scope of the invention.

Alternative Scaffolds

As would be evident to one of ordinary skill in the art, the CDRH3 and/or CDRL3 polypeptides provided by the invention may also be displayed on alternative scaffolds. Several such scaffolds have been shown to yield molecules with specificities and affinities that rival those of antibodies. Exemplary alternative scaffolds include those derived from fibronectin (e.g., AdNectin), the β-sandwich (e.g., iMab), lipocalin (e.g., Anticalin), EETI-II/AGRP, BPTI/LACI-D1/ITI-D2 (e.g., Kunitz domain), thioredoxin (e.g., peptide aptamer), protein A (e.g., Affibody), ankyrin repeats (e.g., DARPin), γB-crystallin/ubiquitin (e.g., Affilin), $CTLD_3$ (e.g., Tetranectin), and (LDLR-A module)$_3$ (e.g., Avimers). Additional information on alternative scaffolds is provided, for example, in Binz et al., Nat. Biotechnol., 2005 23: 1257 and Skerra, Current Opin. in Biotech., 2007 18: 295-304, each of which is incorporated by reference in its entirety.

Additional Embodiments of the Invention

Library Sizes

In some embodiments of the invention, a library comprises about $10^1$ to about $10^{20}$ different polynucleotide or polypeptide sequences (encoding or comprising e.g., antibodies, heavy chains, CDRH3s, light chains, and/or CDRL3s). In some embodiments, the libraries of the invention are designed to include at least about $10^1$, $10^2$, $10^3$, $10^4$, $10^5$, $10^6$, $10^7$, $10^8$, $10^9$, $10^{10}$, $10^{11}$, $10^{12}$, $10^{13}$, $10^{14}$, $10^{15}$, $10^{16}$, $10^{17}$, $10^{18}$, $10^{19}$, or $10^{20}$, or more different antibody, heavy chain, CDRH3, light chain, and/or CDRL3 polynucleotide or polypeptide sequences. In some embodiments, a library of the invention may contain less than a particular number of polynucleotide or polypeptide sequences, where the number of sequences is defined using any one of the integers provided above. In certain embodiments of the invention, a particular numerical range is defined, using any two of the integers provided above as lower and upper boundaries of the range, inclusive or exclusive. All combinations of the integers provided, which define an upper and lower boundary, are contemplated.

In some embodiments, the invention provides libraries wherein a fraction of the members of the library are members produced according to the methods, systems, and compositions provided herein. One important property of the libraries of the invention is that they favorably mimic certain aspects of the human preimmune repertoire, including length diversity and sequence diversity. One or ordinary skill in the art will readily recognize that libraries provided by the invention include libraries where a subset of the members of the library are members produced according to the methods, systems, and compositions provided herein. For example, a library containing $10^8$ members wherein $10^6$ members are produced according to the methods, systems, and compositions provided herein, would contain 1% sequences produced according to the methods, systems, and compositions provided herein. One of ordinary skill in the art would recognize that one or more of the $10^6$ members could readily be isolated using screening techniques known in the art. Therefore, said libraries fall within the scope of the invention. More specifically, libraries comprising at least about 1%, 2.5%, 5%, 10%, 15%, 20%, 25%, 30%, 40%, 45%, 50%, 55%, 60%, 65%, 70%, 75%, 80%, 85%, 90%, 95%, or 99% CDRH3, CDRL3, light chain, or heavy chain, and/or full-length antibody sequences provided herein fall within the scope of the invention. Libraries comprising at least about $10^3$, $10^4$, $10^5$, $10^6$, $10^7$, $10^8$, $10^9$, $10^{10}$, $10^{11}$, $10^{12}$, $10^{13}$, $10^{14}$, $10^{15}$ CDRH3, CDRL3, light chain, heavy chain, and/or full-length antibody sequences provided herein also fall within the scope of the invention.

Human Preimmune Set

In some embodiments, the invention comprises the set of 3,571 curated human preimmune antibody sequences contained within the HPS, their corresponding CDRH3 sequences (Appendix A), and/or a representation of these CDRH3 sequences (and/or TN1, DH, N2, and/or H3-JH segments thereof) in a computer readable format. In certain embodiments, the invention comprises a method of producing a CDRH3 library, the method comprising matching candidate segments (i.e., TN1, DH, N2, and H3-JH) from a theoretical segment pool with CDRH3 sequences in the HPS and/or any other repertoire of CDRH3 sequences. In some embodiments, the invention comprises the candidate segments from the theoretical segment pools disclosed herein and/or the segments selected for inclusion in a physical library.

Embodiments

While the methods described herein demonstrate the production of theoretical segment pools of H3-JH and DH segments using a limited number of allelic variants, one of ordinary skill in the art will recognize that methods taught herein may be applied to any IGHJ and IGHD genes, including any other allelic variants and all non-human IGHJ and IGHD genes. Alternatively or additionally, methods described herein may be applied to any reference set of CDRH3 sequences, for example to extract additional TN1 and/or N2 segments. Alternatively or additionally, one of ordinary skill in the art will recognize that each of the described embodiments of the invention may be in polynucleotide or polypeptide form, within a vector, virus, or microorganism (e.g., a yeast or bacteria). Furthermore, since the invention involves synthetic libraries that are fully enumerated, certain embodiments of the invention relate to any of the embodiments described above in a computer readable format, and uses thereof.

Non-human antibody libraries also fall within the scope of the invention.

The present disclosure describes the removal of sequences containing Cys residues, N-linked glycosylation motifs, deamidation motifs, and highly hydrophobic sequences from the libraries of the invention. One of ordinary skill in the art will recognize that one or more of these criteria (i.e., not necessarily all) can be applied to remove undesirable sequences from any library of the invention. However, libraries containing one or more of these types of sequences also fall within the scope of the invention. Other criteria can also be used; those described herein are not limiting.

In certain embodiments, the invention provides libraries in which the number of times a particular sequence is repeated within the library (either theoretical, synthetic, or physical realization) is limited. For example, in some embodiments, the invention provides libraries wherein the frequency of occurrence of any of the sequences in the library (e.g., CDRH3, CDRL3, heavy chain, light chain, full-length antibody) is less than about 2, 5, 10, 15, 20, 25, 30, 35, 40, 45, 50, 55, 60, 65, 70, 75, 80, 85, 90, 95, 100, 200, 300, 400, 500, 600, 700, 800, 900, or 1000. In some embodiments, the frequency of occurrence of any of the sequences in the library is less than a multiple of the frequency of occurrence of any other sequence in the library, for examples less than about 2, 5, 10, 15, 20, 25, 30, 35, 40, 45, 50, 55, 60, 65, 70, 75, 80, 85, 90, 95, 100, 200, 300, 400, 500, 600, 700, 800, 900, or 1000 times the frequency of occurrence of any other sequence in the library.

In some embodiments, libraries are defined by the combinatorial diversity of the segments used to produce CDRH3 sequences, in particular the number of non-degenerate segment combinations that can be used to produce a particular CDRH3 sequence. In some embodiments, this metric may be calculated using, for example, a sample of about 2000, 5000, 10000, 20000, 50000, 100000, or more sequences from the CDRH3 library and "self-matching" using the segments used to generate the CDRH3 sequences of that library. In certain embodiments, the invention provides libraries wherein at least about 95%, 90%, 85%, 80%, 75%, 70%, 65%, 60%, 55%, 50%, 45%, 40%, 35%, 30%, 25%, 20%, 15%, 10%, or 5% of the CDRH3 sequences in the library may be formed by a single combination of segments.

In certain embodiments of the invention, a statistical bootstrap analysis was used to generate CDRH3 reference sets.

While it may be advantageous to use this method, it is not required for every embodiment of the invention.

In some embodiments, the invention provides methods and systems of selecting polynucleotides to encode polypeptides of the invention, comprising selecting polynucleotide segments lacking (or containing) certain restriction sites individually and/or after combinatorial concatenation with other segments (e.g., see Example 9.3.7).

The exemplary libraries provided herein are not limiting and provided for exemplification only.

EXAMPLES

This invention is further illustrated by the following examples which should not be construed as limiting. The contents of all references, patents and published patent applications cited throughout this application are hereby incorporated by reference.

In general, the practice of the present invention employs, unless otherwise indicated, conventional techniques of chemistry, molecular biology, recombinant DNA technology, PCR technology, immunology (especially, e.g., antibody technology), expression systems (e.g., yeast expression, cell-free expression, phage display, ribosome display, and PROFUSION™), and any necessary cell culture that are within the skill of the art and are explained in the literature. See, e.g., Sambrook, Fritsch and Maniatis, *Molecular Cloning Cold Spring Harbor Laboratory Press* (1989); *DNA Cloning*, Vols. 1 and 2, (D. N. Glover, Ed. 1985); Oligonucleotide Synthesis (M. J. Gait, Ed. 1984); *PCR Handbook Current Protocols in Nucleic Acid Chemistry*, Beaucage, Ed. John Wiley & Sons (1999) (Editor); *Oxford Handbook of Nucleic Acid Structure*, Neidle, Ed., Oxford Univ Press (1999); *PCR Protocols: A Guide to Methods and Applications*, Innis et al., Academic Press (1990); *PCR Essential Techniques: Essential Techniques*, Burke, Ed., John Wiley & Son Ltd (1996); *The PCR Technique: RT-PCR*, Siebert, Ed., Eaton Pub. Co. (1998); *Antibody Engineering Protocols (Methods in Molecular Biology)*, 510, Paul, S., Humana Pr (1996); *Antibody Engineering: A Practical Approach (Practical Approach Series, 169)*, McCafferty, Ed., Irl Pr (1996); *Antibodies: A Laboratory Manual*, Harlow et al., C.S.H.L. Press, Pub. (1999); *Current Protocols in Molecular Biology*, eds. Ausubel et al., John Wiley & Sons (1992); *Large-Scale Mammalian Cell Culture Technology*, Lubiniecki, A., Ed., Marcel Dekker, Pub., (1990); *Phage Display: A Laboratory Manual*, C. Barbas (Ed.), CSHL Press, (2001); *Antibody Phage Display*, P O'Brien (Ed.), Humana Press (2001); Border et al., Nature Biotechnology, 1997, 15: 553; Border et al., Methods Enzymol., 2000, 328: 430; ribosome display as described by Pluckthun et al. in U.S. Pat. No. 6,348,315, and Profusion™ as described by Szostak et al. in U.S. Pat. Nos. 6,258,558; 6,261,804; and 6,214,553; and bacterial periplasmic expression as described in US20040058403A1. Each of the references cited in this paragraph is incorporated by reference in its entirety.

Further details regarding antibody sequence analysis using Kabat conventions and programs to analyze aligned nucleotide and amino acid sequences may be found, e.g., in Johnson et al., Methods Mol. Biol., 2004, 248: 11; Johnson et al., Int. Immunol., 1998, 10: 1801; Johnson et al., Methods Mol. Biol., 1995, 51: 1; Wu et al., Proteins, 1993, 16: 1; and Martin, Proteins, 1996, 25: 130. Each of the references cited in this paragraph is incorporated by reference in its entirety.

Further details regarding antibody sequence analysis using Chothia conventions may be found, e.g., in Chothia et al., J. Mol. Biol., 1998, 278: 457; Morea et al., Biophys. Chem., 1997, 68: 9; Morea et al., J. Mol. Biol., 1998, 275: 269; Al-Lazikani et al., J. Mol. Biol., 1997, 273: 927. Bane et al., Nat. Struct. Biol., 1994, 1: 915; Chothia et al., J. Mol. Biol., 1992, 227: 799; Chothia et al., Nature, 1989, 342: 877; and Chothia et al., J. Mol. Biol., 1987, 196: 901. Further analysis of CDRH3 conformation may be found in Shirai et al., FEBS Lett., 1999, 455: 188 and Shirai et al., FEBS Lett., 1996, 399: 1. Further details regarding Chothia analysis are described, for example, in Chothia et al., Cold Spring Harb. Symp. Quant Biol., 1987, 52: 399. Each of the references cited in this paragraph is incorporated by reference in its entirety.

Further details regarding CDR contact considerations are described, for example, in MacCallum et al., J. Mol. Biol., 1996, 262: 732, incorporated by reference in its entirety.

Further details regarding the antibody sequences and databases referred to herein are found, e.g., in Tomlinson et al., J. Mol. Biol., 1992, 227: 776, VBASE2 (Retter et al., Nucleic Acids Res., 2005, 33: D671); BLAST (www.ncbi.nlm.nih.gov/BLAST/); CDHIT (bioinformatics.ljcrf.edu/cd-hi/); EMBOSS (www.hgmp.mrc.ac.uk/Software/EMBOSS/); PHYLIP (evolution.genetics.washington.edu/phylip.html); and FASTA (fasta.bioch.virginia.edu). Each of the references cited in this paragraph is incorporated by reference in its entirety.

Light Chain Libraries

Example 1

Light Chain Libraries with Framework and/or CDRL1 and/or CDRL2 Variability

Although the diversity in antibody sequences is concentrated in the CDRs, certain residues in the framework regions can also influence antigen recognition and/or modulate affinity (Queen et al., Proc. Natl. Acad. Sci. USA, 1989, 86: 10029; Carter et al., Proc. Natl. Acad. Sci. USA, 1992, 89: 4285, each incorporated by reference in its entirety). These residues have been cataloged and used to make framework substitutions that improve antibody affinity, for example, during the process of antibody humanization (e.g., see the "Vernier" residues in Foote and Winter, J. Mol. Biol., 1992, 224: 487, incorporated by reference in its entirety). In the heavy chain, the Vernier residues include Kabat-numbered residues 2, 27-30, 47-49, 67, 69, 71, 73, 78, 93-94, and 103. In the light chain, the Vernier residues include Kabat residues 2, 4, 35-36, 46-49, 64, 66, 68-69, 71, and 98. The Vernier residue numbers are the same for kappa and lambda light chain sequences (see Table 4 in Chothia et al., J. Mol. Biol., 1985, 186: 651, which is incorporated by reference in its entirety). Additionally, framework positions at the VL-VH interface may also influence affinity. In the heavy chain, the interface residues include Kabat residues 35, 37, 39, 45, 47, 91, 93, 95, 100, and 103 (Chothia et al., J. Mol. Biol., 1985, 186: 651, incorporated by reference in its entirety). In the light chain, the interface residues include Kabat residues 34, 36, 38 44, 46, 87, 89, 91, 96, and 98.

The following procedure was used to select the framework residues to be varied and the amino acids to which they should be varied:
   a. A collection of human VK light chain DNA sequences was obtained from NCBI (see Appendix A of WO/2009/036379 for GI Nos.). These sequences were classified according to the germline origin of their VK germline segment.
   b. Patterns of variation at each of the Vernier and interface positions were examined as follows:

i. Equation 1 (from Makowski & Soares, Bioinformatics, 2003, 19: 483, incorporated by reference in its entirety) was used to calculate a diversity index for the Vernier positions, interface positions, CDRL1, and CDRL2.

$$d = \frac{1}{N \sum p_i^2}$$ Equation 1

Here, d is the diversity index, N is 20, the total number of amino acid types, and $p_i$ is the fraction of amino acid of type "i" at the position of interest. The sum is carried out over the 20 amino acid types. The parameter d will attain its minimum value of 0.05 or 1/20, when a single amino acid type is observed at a given position: $p_i$ is 1 for one type and zero for all the rest. Conversely, when all the amino acid types are equally probable (e.g., $p_i$ is 0.05 for all i), d will attain its maximum value of 1.0.

ii. The diversity index for each of the Vernier and interface positions were compared to the diversity index for the positions in CDRL1 and CDRL2.

iii. The interface positions were found to be relatively invariant, with d values very close to the minimum of 0.05, and were thus not altered. The Vernier residues with a diversity index comparable to or larger than that of the CDR positions (i.e., at or above 0.07 for the particular example provided in FIG. 1) were selected as candidates for variance (see FIG. 1). The amino acid residues included in these positions were selected from amongst the two to three amino acids most frequently occurring in that position in the sequences in the collection of human VK light chains, for each particular VK germline.

iv. Table 2 shows the positions selected for variance in each of nine exemplified light chain germlines. The alternative framework positions represent positions with a diversity index less than the primary framework positions, but where variability may still be incorporated to influence antigen binding.

v. The amino acid residues in the framework positions selected for variance were varied as follows (Table 3 provides the polypeptide sequences of these variants):
  1. Position 2: Germline I was optionally changed to V.
  2. Position 4: Germline M or L was optionally changed to L or M. In some embodiments, changes from M to L, but not the reverse, may be preferred, because M may undergo oxidation during production, processing, or storage, potentially altering the properties of the antibody.
  3. Position 36: Germline Y was optionally changed to F and H.
  4. Position 46: Germline L was optionally changed to V.
  5. Position 48: Germline I was optionally changed to L.
  6. Position 49: Germline Y was optionally changed to S, F, and H.
  7. Position 66: Germline G was optionally changed to R and E.

One of ordinary skill in the art would readily recognize that the procedure outlined above could also be used to select positions to vary in Vλ germline sequences, and that libraries containing Vλ chains also fall within the scope of the invention.

In addition to the framework mutations, variability was also introduced into CDRL1 and CDRL2. This was performed by determining which residues in CDRL1 and CDRL2 were variable, within a particular germline, in the VK dataset used above and incorporating the most frequently occurring 2 to 4 variants into CDRL1 and CDRL2 in the synthetic libraries of the invention. With the exception of position 50 of CDRL2 of the VK1-5 germline, these alternatives did not arise from allelic variation. Table 3 shows the polypeptide sequences of nine light chain chassis and their framework and CDR L1/L2 variants for the currently exemplified embodiment of the invention. The amino acid residues in the CDRL1/L2 positions selected for variance were varied as follows (using the Chothia-Lesk numbering system; Chothia and Lesk, J. Mol. Biol., 1987, 196: 901):
  1. Position 28: Germline S or G were optionally changed to G, A, or D.
  2. Position 29: Germline V was optionally changed to I.
  3. Position 30: Germline S was optionally changed to N, D, G, T, A, or R.
  4. Position 30A: Germline H was optionally changed to Y
  5. Position 30B: Germline S was optionally changed to R or T.
  6. Position 30E: Germline Y was optionally changed to N.
  7. Position 31: Germline S was optionally changed to D, R, I, N, or T.
  8. Position 32: Germline Y or N were optionally changed to F, S, or D.
  9. Position 50: Germline A, D, or G were optionally changed to G, S, E, K, or D.
  10. Position 51: Germline G or A were optionally changed to A, S, or T.
  11. Position 53: Germline S or N were optionally changed to N, H, S, K, or R.
  12. Position 55: Germline E was optionally changed to A or Q.

Example 2

Light Chain Libraries with Enhanced Diversity in CDRL3

Figure 2:
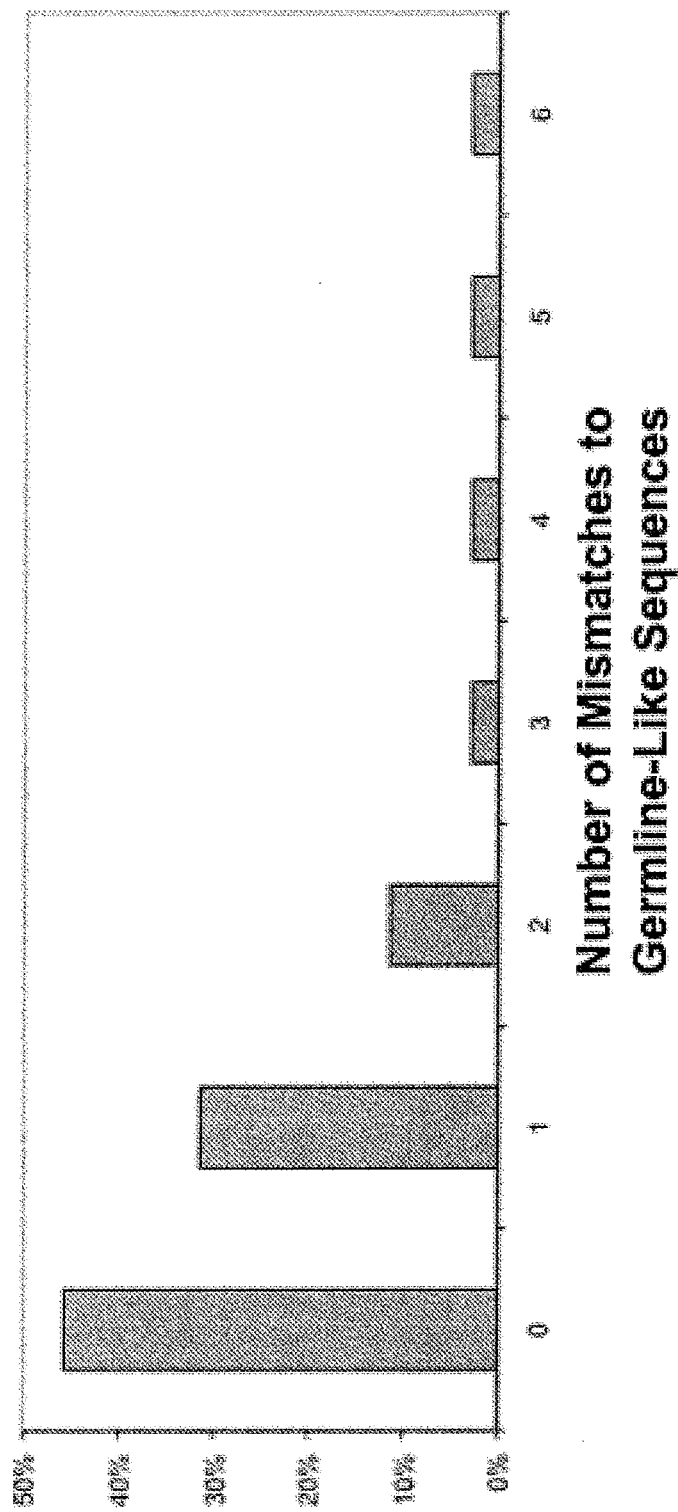
FIG. 2 shows that clinically validated CDRL3 sequences deviate little from germline-like sequences (n=35).

A variety of methods of producing light chain libraries are known in the art (e.g., see U.S. Publication Nos. 2009/0181855, 2010/0056386, and WO/2009/036379). An analysis of clinically validated antibody sequences indicated that these sequences have very little deviation from germline-like VL-JL (where "L" can be a kappa or lambda germline sequence) rearrangements prior to somatic mutation (FIG. 2). Here, a germline-like rearrangement is one where neither the V nor J portion differ from the respective germline genes and, for the purposes of this particular example, where the length of CDRL3 is restricted to 8, 9 or 10 amino acids (see U.S. Publication Nos. 2009/0181855, 2010/0056386, and WO/2009/036379). For the IGHJK1 gene, however, both WT (Trp-Thr) and RT (Arg-Thr) sequences (the first two N-terminal residues) are considered "germline-like" and so are full L3 rearrangements containing such sequences. Therefore, new light chain libraries were designed and constructed with the objectives of simultaneously (1) minimizing deviation from germline-like sequences, as defined above; and (2) generating maximal diversity. In particular, the overarching goal was to maximize the type of diversity that is indicated to be most favorable by clinically validated antibody sequences. In particular, the designed library sought to maximize the diversity of CDRL3 sequences that differ from length-matched germline sequences by two amino acids or fewer.

This was accomplished by utilizing a "jumping dimer" or "jumping trimer" approach to light chain oligonucleotide design. The jumping dimer approach involves the incorporation of degenerate codons at each of the six positions of CDRL3 encoded by the VL segment (L3-VL). At most two positions vary from germline in each individual L3-VL sequence, but the two positions do not have to be adjacent to one another. Thus, the total number of designed degenerate oligonucleotides synthesized per VL chassis is 6!/(4!2!), or fifteen (accounting for six of the most commonly occurring amino acids at the junction (position 96) between VL and JL for each kappa germline chassis (namely F, L, I, R, W, Y, and P; see U.S. Publication Nos. 2009/0181855 and 2010/0056386, and WO/2009/036379, each of which is incorporated by reference in its entirety, for more details on the junctional amino acids at position 96). The jumping trimer approach is analogous to the jumping dimer approach, but with three positions varying from germline in each individual L3-VL sequence, instead of two as in the jumping dimer. The degenerate codons selected for each position in the jumping dimer and trimer approaches were chosen to (1) to reproduce the diversity contained in the known repertoire of publicly available human VK sequences (see Appendix A of WO/2009/036379); and (2) to minimize or eliminate undesirable sequences within the CDRL3s of the resulting synthetic light chains, such as N-linked glycosylation motifs (NXS/NXT), Cys residues, stop codons, and deamidation-prone NG motifs. Table 4 shows the fifteen degenerate oligonucleotides encoding the VK1-39 CDRL3 sequences with a length of nine amino acids and F or Y as the junctional amino acid, and the corresponding degenerate polypeptide sequences. Table 5, Table 6, and Table 7 provide the oligonucleotide sequences for each of the VK sequences of the exemplary jumping dimer and trimer libraries, for CDRL3 lengths of 8, 9, and 10, respectively, and the sequences for the corresponding CDRL3s.

The number of unique CDRL3 sequences within each germline library was then enumerated and compared to the number of unique CDRL3 sequences in a different light chain library, designated "VK-v1.0" (see Example 6.2 in US Publication No. 2009/0181855), for each of the three lengths. Table 8 provides the number of unique CDRL3 sequences in each of the respective germline libraries.

Figure 3:
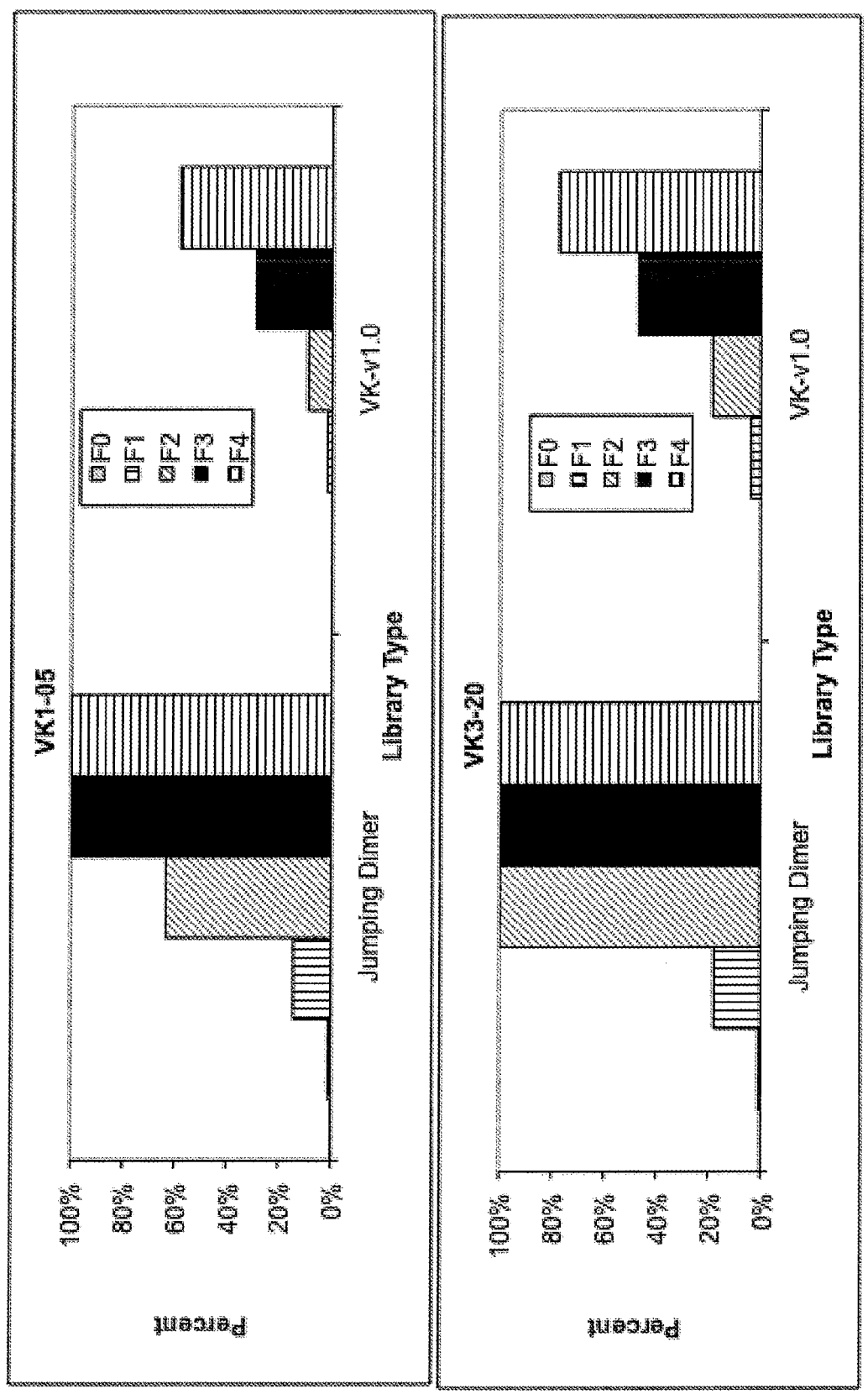
FIG. 3 shows the percent of sequences in the jumping dimer CDRL3 libraries of the invention and a previous CDRL3 library, VK-v1.0, with X or fewer mutations from germline. Here, FX is the percentage of sequences in a library with X or fewer mutations from germline.

FIG. 3 provides the percentage of sequences in the jumping dimer and VK-v1.0 libraries with CDRL3 length of nine amino acids that contain no mutations from germline-like sequences (Table 1) or 1, 2, 3, or 4 or fewer mutations from germline-like sequences. Naturally-occurring VK1-05 sequences are almost as likely to have Ser (germline amino acid type) as Pro at Kabat position 95, thus both residues (S and P) were incorporated in the synthetic libraries representing VK1-05 repertoires. However, as indicated in Table 1, only Ser was considered to be a germline-like residue at position 95 for the purposes of this analysis when the VK gene is VK1-05. The plot for VK3-20 is representative of the remaining chassis in the library for a length nine. All of the sequences in the VK1-05 library were within three amino acids of human germline sequences, and approximately 63% of the sequences were within two amino acids of human germline-like sequences. For the rest of the libraries, and as designed, 100% of the sequences were within two amino acids of human germline-like sequences; thus, over 95% of the sequences of length 9 in the jumping dimer library considered as a whole were within 2 amino acids of germline-like sequences. By comparison, only 16% of the members of the VK-v1.0 libraries of length nine amino acids are within two amino acids of the corresponding human germline-like sequences. For length 8, about 98% of the sequences in the jumping dimer libraries were within two amino acids of germline-like, versus about 19% for VK-v1.0. For length 10, more than 95% of the sequences of the jumping dimer library were within two amino acids of germline-like, versus about 8% for VK-v1.0.

In some embodiments, to concentrate the diversity in positions most likely to be solvent-exposed in the folded antibody, positions 89 and 90 (Kabat numbering) are not modified from germline—these are most often QQ, but the sequence is MQ for the VK2-28 chassis. Other VK germline genes have different sequences at positions 88-89, and the use of these genes as chassis also falls within the scope of the invention. For example, VK1-27 has QK, VK1-17 and VK1-6 both have LQ, and so on. The sequences in these positions are known in the art and can be obtained, for example, from Scaviner et al., Exp. Clin. Immunogenet., 1999, 16: 234 (see FIG. 2), which is incorporated by reference in its entirety.

CDRH3 Libraries

The following examples describe methods and compositions useful for the design and synthesis of antibody libraries with improved CDRH3 sequences in comparison to libraries known in the art. The CDRH3 sequences of the invention have enhanced diversity in comparison to libraries known in the art, while retaining the character of human sequences, improving combinatorial efficiency of the synthetic CDRH3 segments, and/or improving the matching between synthetic CDRH3 sequences and human CDRH3 sequences in one or more reference sets.

Example 3

Generating a Curated Reference Set of Human Preimmune CDRH3 Sequences

A file containing approximately 84,000 human and mouse heavy chain DNA sequences was downloaded from the BLAST public resource (ftp.ncbi.nih.gov/blast/db/FASTA/; filename: igSeqNt.gz; download date: Aug. 29, 2008). Of these approximately 84,000 sequences, approximately 34,000 sequences were identified as human heavy chain sequences based on analysis of the sequence header annotation. These sequences were then filtered as follows: First, all sequences were classified, via their VH-region, according to their corresponding (closest matched) VH germline. Sequences that were of an incorrect or insufficient length, or that could not be matched due to extensive mutation, were discarded. Second, any sequences containing more than five mutations, at the DNA level, when compared to their corresponding germline VH sequence were also discarded. It was assumed, consistent with Rada and Milstein, EMBO J., 2001, 20: 4570, that mutations (or lack thereof) in the N-terminal portion of the variable region may be used as conservative surrogates for mutations (or lack thereof) in the C-terminal portion of the variable region, in particular in CDRH3. Therefore, selecting only sequences with five or fewer nucleotide mutations in VH, which is N-terminal to CDRH3 is highly likely to also select for CDRH3 sequences that are either lightly mutated or not mutated at all (i.e., having preimmune character).

After translating the remaining DNA sequences into their amino acid counterparts, the appropriate reading frame containing the heavy chain germline amino acid sequence was identified and used to identify the sequences of the CDRs, including that of the CDRH3. The list of CDRH3 sequences obtained at this point was further filtered to eliminate members that did not differ from any other sequence in the set by at least three amino acids (after matching for length). This process yielded 11,411 CDRH3 sequences, with 3,571 sequences annotated as originating from healthy adults ("Healthy Preimmune Set" or "HPS"; see Appendix A for GI Nos.) and the other 7,840 sequences annotated as originating from individuals suffering from disease, of fetal origin, or of antigen-specific origin. The methods described below were then used to deconvolute each of the sequences in the HPS into the four segments that constitute the CDRH3: (1) TN1, (2) DH, (3) N2, and (4) H3-JH.

Example 4

Method to Match Segments from a Theoretical Segment Pool to CDRH3s in a Reference Set This example describes the method used to identify the TN1, DH, N2, and H3-JH segments of the CDRH3s in the HPS. The currently exemplified approach to the design and synthesis of human CDRH3 sequences mimics the segmental V-D-J gene recombination processes by which the human immune system generates the preimmune CDRH3 repertoire. The matching method described here determines which TN1, DH, N2 and H3-JH segments have been used to produce a particular CDRH3 across a reference set of CDRH3s (e.g., the HPS). This information is then used, optionally in conjunction with other information described below (e.g., physicochemical properties), to determine which TN1, DH, N2, and H3-JH segments from a theoretical segment pool (or segments extracted from the CDRH3 sequences in the reference set, in the case of the TN1 and N2) should be included in a synthetic CDRH3 library.

The inputs to the matching method are: (1) a reference set of CDRH3 sequences (e.g., the human CDRH3 sequences in the HPS), and (2) a theoretical segment pool, containing a plurality of TN1, DH, N2 and/or H3-JH segments. Methods by which the members of the theoretical segment pool are generated are more fully described below. For each CDRH3 in the reference set, the matching method generates two outputs: (i) a list of the closest matched CDRH3 sequences that can be generated using the segments of the theoretical segment pool, and (ii) the one or more segment combinations from the theoretical segment pool that can be used to create these closest matched CDRH3 sequences.

The matching method was performed as follows: Each TN1 segment in the theoretical segment pool was aligned at its first amino acid with the first amino acid (position 95) of the CDRH3 sequence from the reference set. For each segment length, all (i.e., one or more) of the segments returning the best matches are retained, and the remaining segments are discarded. The retained TN1 segments are then concatenated with all DH segments from the theoretical segment pool, to create [TN1]-[DH] segments. These segments are then aligned as above, and all the best matches for each of the [TN1]-[DH] segments are retained. The procedure is repeated with [TN1]-[DH]-[N2] and [TN1]-[DH]-[N2]-[H3-JH] segments until the length of the CDRH3 sequence from the reference set is identically recapitulated by the segment combinations from the theoretical segment pool. All segment combinations returning the best match to the CDRH3s in the reference set are retained as the output of the matching method.

Table 9 provides an example of the output of the matching method, specifically the output for four individual sequences from the HPS, using a theoretical segment pool designated "Theoretical Segment Pool 1," or "TSP1". TSP1 contains several theoretical segment pools, namely: 212 TN1 segments (Table 10), 1,111 DH segments (Table 11), 141 N2 segments (Table 12), and 285 H3-JH segments (Table 13). The CDRH3 sequence in Test Case 1 contains an identical match in TSP1 that is reached via a unique combination of the four segments. Test Cases 2.1 and 2.2 each return an identical match, but via two distinct combinations that differ in the TN1 and DH segments. In Test Cases 3.1, 4.1, and 4.2, the closest matches are all a single amino acid away from the reference CDRH3, and can be reached via one (3.1) or two (4.1 and 4.2) combinations of segments from TSP1. This approach can be generalized to find all of the closest matches to any reference CDRH3 sequence within any theoretical segment pool and all combinations of the segments within the theoretical segment pool that can produce the reference CDRH3 sequence exactly and/or its closest matches.

Example 5

Deriving Theoretical Segment Pools of H3-JH Segments

In order to produce theoretical segment pools of H3-JH segments for consideration for inclusion in a synthetic CDRH3 library, the following method was applied to generate mutants of seven (IGHJ1-01, IGHJ2-01, IGHJ3-02, IGHJ4-02, IGHJ5-02, IGHJ6-02 and IGHJ6-03) of the twelve germline IGHJ sequences of Table 14. These seven alleles were chosen because they were among the most commonly occurring alleles in human sequences. Libraries where all sequences of Table 14 (some differing only in FRM4) are used to generate H3-JH and/or JH (i.e., H3-JH and FRM4) also fall within the scope of the invention. The method is intended to simulate the creation of junctional diversity during the V-D-J recombination process in vivo, which occurs via enzyme-mediated addition and deletion of nucleotides to the germline gene segments. The method proceeds as follows, and results in a fully enumerated theoretical segment pool of H3-JH segments:

1. A pre-treatment was applied to the IGHJ genes that contain a partial codon consisting of two nucleotide bases at their 5' terminus (IGHJ3-02, IGHJ4-02, IGHJ5-02, IGHJ6-02 and IGHJ6-03), prior to the first nucleotide encoding the translation of the JH segment that produces the well-known JH framework regions. For example, the IGHJ3-02 gene contains an AT dinucleotide sequence prior to the first nucleotide encoding the translation of the JH segment that produces the JH framework region (FIG. 4, top). All partial codons consisting of two nucleotide bases were completed, using all possible nucleotide doublets (i.e., NN) at their two most 5' positions (FIG. 4, top, second row for IGHJ3-02). More specifically, the most 5' nucleotide in the germline sequence was mutated to N and an additional N was added 5' to that nucleotide.

2. IGHJ genes IGHJ1-01 (FIG. 4, center) and IGHJ2-01 (FIG. 4, bottom) contain zero and one nucleotide base(s) at their 5' termini, prior to the first nucleotide encoding the translation of the JH segment that produces the JH framework region. For these genes, the pre-treatment described in step 1 was not performed. Instead, the 5' doublets were mutated to NN (FIG. 4, middle and bottom, second row of each). Therefore, after performing this step, each of the seven IGHJ genes enumerated above was converted to a variant with an NN doublet as its first two 5' positions.

3. The 5' codons of the sequences produced via steps 1 and 2 were then deleted, and the first two bases of the resulting DNA sequence were subsequently mutated to an NN doublet (FIG. 4, rows 3-4 for all).
4. The 5' codons of the sequences produced in step 3 were then deleted, and the first two bases of the resulting DNA sequence were subsequently mutated to an NN doublet (FIG. 4, rows 5-6 for all).
5. Each of the polynucleotide sequences generated by steps (1)-(4) were then translated, to obtain a theoretical segment pool consisting of 248 parent H3-JH polypeptide segments (Table 15) from the reading frame for each sequence that produced the JH framework region.
6. The parent H3-JH polypeptide segments were truncated at their N-termini, by removing one amino acid at a time until only the portion of the JH segment comprising FW4 remains (i.e., an H3-JH segment with a length of zero amino acids).

The methods described above resulted in the production of a theoretical segment pool of 285 H3-JH segments (Table 13).

Example 6

Deriving Theoretical Segment Pools of DH Segments

Two theoretical pools of DH segments were generated, using one or more of two translation methods, designated "Translation Method 0" (TM0), or "Translation Method 1" ("TM1"), each performed in the three forward reading frames of 27 human germline IGHD DNA sequences or segments derived therefrom (Table 16).

The 1K DH Theoretical Segment Pool (1K DH)

TM1 was used to generate the "1K DH Theoretical Segment Pool" ("1K DH"; see the 1,111 DH segments of Table 11). In TM1, IGHD sequences that had a partial codon containing two untranslated bases after translation in any of the three forward reading frames were completed to produce a full codon only if the two bases could encode only a single amino acid upon completion. For example, a DNA sequence such as TTA-GCT-CG has two full codons that would be translated to LA, and a remaining partial codon (CG) that can only encode R, as any of CGA, CGC, CGG, or CGT will encode R. Thus, applying TM1 to this sequence will yield LAR. For sequences with partial codons that could encode more than one amino acid (e.g., GA or AG), the partial codons were ignored. Applying TM1 to the 27 IGHD sequences of Table 16 generated a theoretical segment pool containing the 73 DH parent segments of Table 17 (some containing stop codons ("Z") and unpaired Cys residues). These sequences were then progressively deleted at the amino acid level, at their N- and C-termini, until only two amino acids remained. Truncated segments were discarded if they contained a stop codon, unpaired Cys residues, N-linked glycosylation motifs, or deamidation motifs. This process yielded the 1,111 DH segments of Table 11.

The 68K DH Theoretical Segment Pool (68K DH)

The 27 IGHD genes and alleles of Table 16 were progressively deleted on either or both of their 5' and 3' ends until four bases remained, yielding 5,076 unique polynucleotide sequences of four or more nucleotides. These 5,076 sequences were subjected to systematic addition of 0, 1 and/or 2 N nucleotides their 5' and/or 3' ends. The resulting sequences were translated using TM0. In TM0, only full codons are translated; partial codons (i.e., 1 or 2 bases) are ignored. This method yielded 68,374 unique DH polypeptide segments after elimination of segments with stop codons, unpaired Cys residues, Asn in the last or next to last position that can lead to N-linked glycosylation motifs, and deamidation motifs (the "68K DH Theoretical Segment Pool"). Using the IGHD genes of Table 16 as an input for the PYTHON computer code provided below will reproduce the exact theoretical segment pool of 68,374 DH segments. There are two free parameters in this program: (1) the minimum length of the DNA sequences remaining after progressive deletions (4 bases in this example), and (2) the minimum length of the peptide sequences (2 amino acids in this example) acceptable for inclusion in the theoretical segment pool. These parameters can be changed to alter the output of the program. For example, changing the first parameter to one base and the second parameter to one amino acid would lead to a larger theoretical segment pool with 68,396 unique sequences, including 18 single-amino acid segments. DH segments progressively truncated to different lengths also fall within the scope of the invention; for example those truncated to 1, 2, 3, or 4 or more amino acids, or 1, 2, 3, 4, 5, 6, 7, 8, 9, 10, or more nucleotides prior to translation.

---

PYTHON Computer Program to Generate 68,374 DH Segments

```
import math, sys, string
class genes:
    name = 'x'
    seq = 'x'
    progdel = set( )
class table:
    name = 'x'
    dna = 'x'
    dna_n = 20 * ['x']
    prot = 60 * ['x']
    uprot = set( )
pepcod = {'A':0, 'C':1, 'D':2, 'E':3, 'F':4, 'G':5, 'H':6,
'I':7, 'K':8, 'L':9, 'M':10,
'N':11, 'P':12, 'Q':13, 'R':14, 'S':15, 'T':16, 'V':17, 'W':18,
'Y':19, 'Z':20}
codpep = 21 * ['']
codpep[0] = 'A'
codpep[1] = 'C'
codpep[2] = 'D'
codpep[3] = 'E'
codpep[4] = 'F'
codpep[5] = 'G'
codpep[6] = 'H'
codpep[7] = 'I'
codpep[8] = 'K'
codpep[9] = 'L'
codpep[10] = 'M'
codpep[11] = 'N'
codpep[12] = 'P'
codpep[13] = 'Q'
codpep[14] = 'R'
codpep[15] = 'S'
codpep[16] = 'T'
codpep[17] = 'V'
codpep[18] = 'W'
codpep[19] = 'Y'
# Z represents a stop codon
codpep[20] = 'Z'
bases = 'ACGT'
def translate_dna(sequence):
    # Translation of input DNA sequence using standard genetic code
    # Only full codons are considered with any remaining 1 or 2 bp
    being ignored
    # Z represents a stop codon
        code = {
        'ATA':'T', 'ATC':'T', 'ATT':'T', 'ATG':'M',
        'ACA':'T', 'ACC':'T', 'ACG':'T', 'ACT':'T',
        'AAC':'N', 'AAT':'N', 'AAA':'K', 'AAG':'K',
        'AGC':'S', 'AGT':'S', 'AGA':'R', 'AGG':'R',
        'CTA':'L', 'CTC':'L', 'CTG':'L', 'CTT':'L',
        'CCA':'P', 'CCC':'P', 'CCG':'P', 'CCT':'P',
        'CAC':'H', 'CAT':'H', 'CAA':'Q', 'CAG':'Q',
        'CGA':'R', 'CGC':'R', 'CGG':'R', 'CGT':'R',
        'GTA':'V', 'GTC':'V', 'GTG':'V', 'GTT':'V',
        'GCA':'A', 'GCC':'A', 'GCG':'A', 'GCT':'A',
```

-continued

PYTHON Computer Program to Generate 68,374 DH Segments

```
        'GAC':'D', 'GAT':'D', 'GAA':'E', 'GAG':'E',
        'GGA':'G', 'GGC':'G', 'GGG':'G', 'GGT':'G',
        'TCA':'S', 'TCC':'S', 'TCG':'S', 'TCT':'S',
        'TTC':'F', 'TTT':'F', 'TTA':'L', 'TTG':'L',
        'TAC':'Y', 'TAT':'Y', 'TAA':'Z', 'TAG':'Z',
        'TGC':'C', 'TGT':'C', 'TGA':'Z', 'TGG':'W',
        }
    proteinseq ''
    for n in range(0, len(sequence), 3):
        if code.has_key(sequence[n:n+3]) == True:
            proteinseq += code[sequence[n:n+3]]
    return proteinseq
# main body starts here
# open input and output files
in1 = open(sys.argv[1], 'r')
ou1 = open(sys.argv[2], 'w')
# read DNA sequences for input DH segments
data = in1.readlines( )
nseg = len(data)
seqs = [ genes( ) for i in range(nseg) ]
for i in range(nseg):
    line = data[i]
    words = string.split(line)
    seqs[i].name = words[0]
    seqs[i].seq = words[1]
    seqs[i].progdel = set( )
# Define here minimum length for DNA (4) and for protein (2)
minlen = 4
minp = 2
# Implement progressive base by base deletion from 5' or 3' or
both ends
alln = 0
for i in range(nseg):
    seq = seqs[i].seq
    lseq = len(seq)
    nt = ct = lseq
    for n in range(nt):
        for c in range(ct):
            nseq = seq[n:lseq-c]
            if (len(nseq) >= minlen):
                seqs[i].progdel.add(nseq)
    alln += len(seqs[i].progdel)
# Collect unique DNA sequences across all DH genes of origin and
ignore redundant ones
progdel = [ table( ) for i in range(alln) ]
n = 0
for i in range(nseg):
    for kk in seqs[i].progdel:
        unix = 1
        for j in range(n):
            if (kk == progdel[j].dna):
                unix = 0
                break
        if (unix == 1):
            progdel[n].name = seqs[i].name
            progdel[n].dna = kk
            n +=1
# Add none, 1 or 2 bp on one or both ends
# extras 20 + 20 * (21) = 20 + 420 = 440
# allocate memory for all variants
for i in range(n):
    progdel[i].dna_n = 440 * ['x']
    progdel[i].prot = 441 *3 * ['x']
    progdel[i].uprot = set( )
# add 1 or 2 bases at each end of input segment
tot = 0
for i in range(n):
# Step over each unique DNA sequence
    k = 0
# One base on 5' end combined with 1 or 2 bases added to 3' end
    for l5 in range(4):
        progdel[i].dna_n[k] = bases[l5] + progdel[i].dna
        k +=1
    for l3 in range(4):
        progdel[i].dna_n[k] = bases[l5] + progdel[i].dna + bases[l3]
        k +=1
    for l3 in range(4):
```

-continued

PYTHON Computer Program to Generate 68,374 DH Segments

```
        for m3 in range(4):
            progdel[i].dna_n[k] = bases[l5] + progdel[i].dna +
bases[l3] + bases[m3]
            k +=1
# One or two bases added to 3' only in this part
    for l3 in range(4):
        progdel[i].dna_n[k] = progdel[i].dna + bases[l3]
        k +=1
    for l3 in range(4):
        for m3 in range(4):
            progdel[i].dna_n[k] = progdel[i].dna + bases[l3] +
bases[m3]
            k +=1
# Two bases on 5' end combined with 1 or 2 bp on 3' end
    for l5 in range(4):
        for m5 in range(4):
            progdel[i].dna_n[k] = bases[l5] + bases[m5] +
progdel[i].dna
            k +=1
    for l3 in range(4):
            progdel[i].dna_n[k] = bases[l5] + bases[m5] +
progdel[i].dna + bases[l3]
            k +=1
    for l3 in range(4):
        for m3 in range(4):
            progdel[i].dna_n[k] = bases[l5] + bases[m5] +
progdel[i].dna + bases[l3] + bases[m3]
            k +=1
# Now translate in all 3 forwarded reading frames
# Save unique peptide sequences
    for fr in range(3):
        piece = progdel[i].dna
        piece = piece[fr:]
        tpiece = translate_dna(piece)
        progdel[i].prot[fr] = tpiece
        progdel[i].uprot.add(tpiece)
    for k in range(440):
        piece = progdel[i].dna_n[k]
        piece = piece[fr:]
        tpiece = translate_dna(piece)
        progdel[i].uprot.add(tpiece)
        progdel[i].prot[3+440*fr +k] = tpiece
    tot += len(progdel[i].uprot)
# Collect unique sequences with no ASN at last or next to last
position, no unpaired or consecutive CYS, no stops
unset = set( )
segm = [ genes( ) for i in range(tot) ]
lux = 0
nn = 0
for i in range(n):
    k = 0
    for kk in progdel[i].uprot:
# Filter out sequences with undesired features, including length
being too short (under "minp" defined above)
        if (len(kk) < minp): continue
        if (kk[len(kk)-1] == "N" or kk[len(kk)-2] == "N"):
continue
        if (kk.count("Z") > 0 or kk.count("CC") >0 or
kk.count("C") % 2 >0): continue
        unset.add(kk)
        lux1 = len(unset)
        if (lux1 > lux):
            segm[nn].name = progdel[i].name + "_" +
str(nn)
            segm[nn].seq = kk
            nn += 1
            lux = lux1
        k +=1
# Print out unique peptide sequences that pass all the filters
for i in range(nn):
    ou1.write("%s\t%s\n" % (segm[i].name, segm[i].seq))
```

Example 7

Deriving Theoretical Segment Pools of TN1 and N2 Segments

The libraries of this example are designed to, in some instances, have a greater diversity in their TN1 and N2 segments in comparison to other libraries known in the art. The diversity of the TN1 and N2 segments was increased by using the matching method described in Example 4 to deconvolute the CDRH3 sequences in the HPS into their constituent segments (i.e., TN1, DH, N2, and H3-JH), followed by extraction of "novel" TN1 and N2 segments in the manner described below. For the purposes of the invention, "novel" TN1 and N2 segments are TN1 and N2 segments that do not appear in a theoretical segment pool that is matched to a reference set of CDRH3 sequences. Following is an example of the method used to extract novel TN1 and N2 segments from the HPS. This method can be generalized to extract novel TN1 and N2 segments from any reference set of CDRH3 sequences, using any theoretical segment pool containing TN1, DH, N2, and/or H3-JH segments.

Table 9 provides the matching results for the reference CDRH3 sequence ERTINWGWGVYAFDI (SEQ ID NO: 8760) (Test Cases 5.1-5.4) from the HPS, using Theoretical Segment Pool 1 ("TSP1"). The best matches to the reference CDRH3 are four CDRH3 sequences, each within three amino acids of the reference CDRH3 sequence. In each of these matches, the TN1, DH, N2 and H3-JH segments are of length 4, 3, 3 and 5 amino acids, respectively. Thus the reference CDRH3 can be deconvoluted into the following segments: ERTI-NWG-WGW-YAFDI (SEQ ID NO: 8761) (i.e. [TN1]-[DH]-[N2]-[H3-JH], respectively). The DH and H3-JH segments from the reference CDRH3, NWG and YAFDI (SEQ ID NO: 4540) respectively, are identically present in TSP1. However, the TN1 (ERTI) (SEQ ID NO: 8718) and N2 (WGW) segments from the reference CDRH3 are absent in TSP1 and match TSP1 segments with one or more amino acid mismatches. These "novel"TN1 and N2 segments are extracted from the reference CDRH3 and considered for inclusion prospective theoretical segment pools and/or synthetic libraries. Additional novel TN1 and N2 segments were accumulated by applying this analysis to all members of the HPS. In order to robustly identify TN1 and N2 sequences, the extraction was performed only for those CDRH3 sequences in which the DH and H3-JH segments in the reference CDRH3 and TSP1 cumulatively return no more than 3 amino acid mismatches, implying that the DH and H3-JH segments of the reference CDRH3 had been reliably assigned.

Example 8

Calculation of Segment Usage Weights

Segment usage weights were calculated for their utility in determining which segments from the theoretical segment pools (e.g., TSP1 and TSP1 plus novel TN1 and N2 segments identified as described in Example 7) should be included in a synthetic library. Segment usage weights were obtained by utilization of the matching method described above and Equation 2:

$$w(i) = \frac{1}{S_m} \sum_{j=1}^{S_m} \frac{1}{g(j)} \sum_{k=1}^{g(j)} f_i(k)$$

Equation 2 where, $w(i)$: Weight for segment i. $0 \leq w(i) \leq 1$.

$S_m$: Number of sequences (out of total S in the reference CDRH3 set) which contain one or more best matches with no more than m amino acid mismatches in the specified region of the reference CDRH3 sequence. Here, the mismatches are computed over the Kabat-CDRH3 region, but other fragments of the CDRH3 sequences may also be considered. A constant value of m=3 was used here, but other values may be used, or the value may depend on the length of the reference CDRH3 sequence.

$g(j)$: Total number of degenerate segment combinations producing the best match to the reference CDRH3 sequence j.

$f_i(k)$: Fractional amino acid identity of TN1, DH, N2 or H3-JH segment in degenerate match k, relative to the corresponding sequence fragment in the reference CDRH3 sequence j. The fractional amino acid identity equals zero if the segment does not appear in match k. Other definitions off, such as amino acid similarity (e.g., based on physicochemical properties of the amino acids such as hydrophobicity), instead of identity, may be also used.

The procedure for calculating segment usage weights will be further exemplified below. In each of these examples, the best match combinations from TSP1 are provided for a single CDRH3 sequence ($S_m=1$) and the degeneracy (k) and fractional mismatch (f) dependent weight calculations are explained.

Example 8.1

Segment usage weights for Test Case 1 in Table 9

Refer to Test Case 1 in Table 9. The CDRH3 sequence RTAHHFDY (SEQ ID NO: 3660) is identically located in TSP1 (f =1, subscripts dropped for simplicity) via a unique segment combination (g =1). Table 18 provides the usage weights for the segments corresponding to the best match from TSP1 for the CDRH3 of Test Case 1.

Example 8.2

Segment usage weights for Test Cases 2.1 and 2.2 in Table 9

Refer to Test Cases 2.1 and 2.2 in Table 9. The CDRH3 sequence VGIVGAASY (SEQ ID NO: 3661) may be identically located in TSP1 (f=1) via two distinct segment combinations (g =2). Table 19 provides the usage weights for the segments corresponding to the best match from TSP1 for the CDRH3 of Test Cases 2.1 and 2.2.

Example 8.3

Segment usage weights for Test Case 3.1 in Table 9

Refer to Test Case 3.1 in Table 9. The CDRH3 sequence DRYSGHDLGY (SEQ ID NO: 3662) may be identically located in TSP1 via a unique segment combination (g =1)

with a single amino acid difference. As provided below, the TN1, N2 and H3-JH segments match the corresponding reference sequence fragments identically, while four of the five DH amino acids match identically.

|  |  |
|---|---|
| Sequence from the HPS: | (SEQ ID NO: 3662)<br>DR-YSGHD-LG-Y |
| Nearest Neighbor in TSP1: | (SEQ ID NO: 8719)<br>DR-YSGYD-LG-Y |

Thus, here $f = 4/5$ for the *DH* segment; and $= 1$ for the *TN*1, *N*2, and *H*3-*JH* segments (Table 20).

Example 8.4

Matching of Test Cases 4.1 and 4.2 in Table 9

Refer to test cases 4.1 and 4.2 in Table 9. The CDRH3 sequence GIAAADSNWLDP (SEQ ID NO: 3663) may be located in TSP1 via two distinct segment combinations (g=2), each with a single amino acid difference. As provided below, the TN1, DH and N2 segments match the corresponding reference sequence fragments identically, while five of the six H3-JH amino acids match identically.

|  |  |
|---|---|
| Sequence from HPS: | (SEQ ID NO: 3663)<br>(-)-GIAAA-D-SNWLDP |
| Nearest Neighbor in TSP1: | (SEQ ID NO: 8720)<br>(-)-GIAAA-D-SNWFDP |
| Sequence from HPS: | (SEQ ID NO: 3663)<br>G-IAAA-D-SNWLDP |
| Nearest Neighbor in TSP1: | (SEQ ID NO: 8720)<br>G-IAAA-D-SNWFDP |

Here, (-) represents the "empty" TN1 segment.

Applying Equation 2 results in the segment usage weights provided in Table 21.

Example 8.5

Calculating the Segment Usage Weights for Test Cases 1 to 4.2 of Table 9

Extending the individual calculations described above to simultaneously include all of Test Cases 1 to 4.2 of Table 9 results in the segment usage weights of Table 22.

Example 8.6

Calculating the Segment Usage Weights for Test Cases 5.1 to 5.4 of Table 9

Refer to the CDRH3 sequence ERTINWGWGVYAFDI (SEQ ID NO: 8760) and the novel TN1 and N2 segments extracted from the CDRH3 sequence, in Example 7. In this case, the novel TN1 and N2 segments (ERTI (SEQ ID NO: 8718) and WGV respectively), and the DH and H3-JH segments from TSP1 (NWG and YAFDI (SEQ ID NO: 4540) respectively) are each assigned usage weights of unity.

Example 9

Selection of TN1, DH, N2 and JH Segments for Inclusion in Synthetic Libraries

Figure 5:
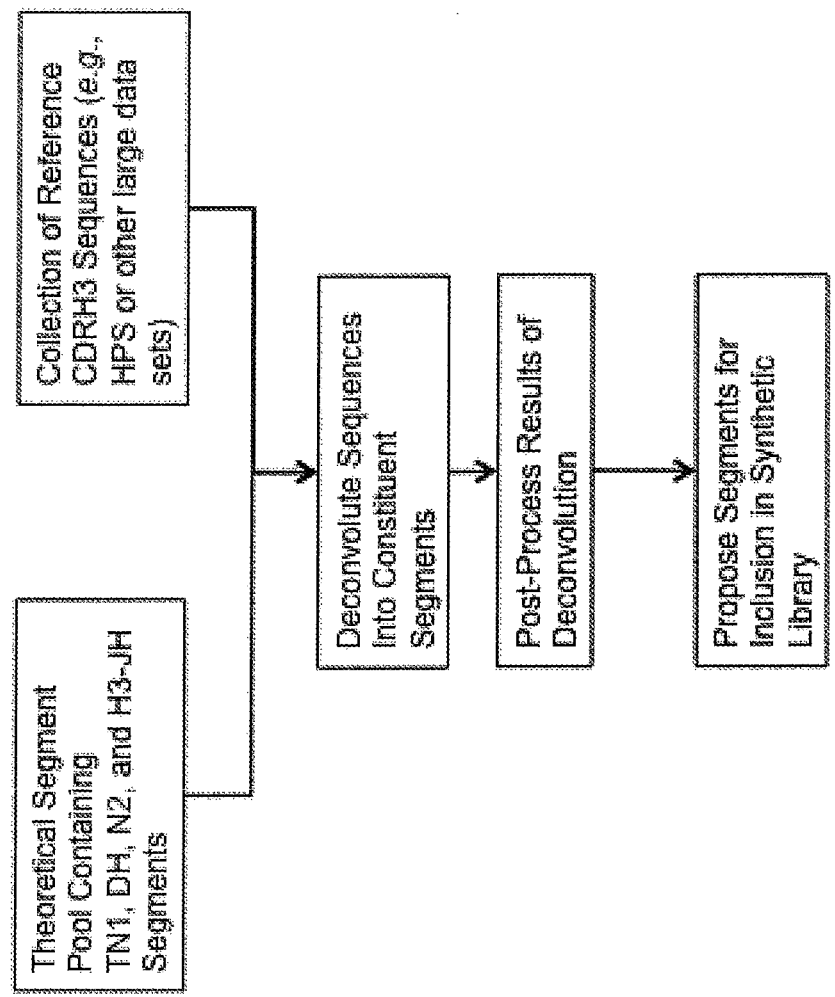
FIG. 5 shows the general schematic of an approach used to select segments from a theoretical segment pool for inclusion in a theoretical and/or synthetic library.

FIG. 5 provides the general method used for the design of synthetic CDRH3 libraries. The method uses as input: (1) a theoretical segment pool containing TN1, DH, N2, and H3-JH segments (e.g., TSP plus novel TN1 and N2 segments); and (2) a collection of reference CDRH3 sequences (e.g., the HPS). From these inputs, a particular subset of segments from the theoretical segment pool is selected for inclusion in a physical CDRH3 library.

First, the best matches to the CDRH3s of the HPS were obtained, from within the TSP1 set, with or without the novel TN1 and N2 segments, using the matching method described above. This data was then used to compute the segment usage weights via Equation 2. Segments were prioritized for inclusion in the physical library based on their relative frequency of occurrence in the CDRH3 sequences of the HPS (as indicated by the segment usage weights), as well as other factors (more fully described below), such as hydrophobicity, alpha-helical propensity, and expressibility in yeast.

Example 9.1

Exemplary Library Design (ELD-1)

ELD-1 uses the HPS and the segments from TSP1 1 (9.5× $10^9$ members) as inputs and produces an output of 100 TN1, 200 DH, 141 N2 and 100 H3-JH segments, each from TSP1, ranked in order by their usage weights in the HPS, to produce a library with theoretical complexity of $2.82 \times 10^8$. The segments corresponding to ELD-1 are provided in Table 23. Note that here the combination of all of the segments (i.e., TN1, DH, N2, and H3-JH), and the individual sets of segments (i.e., TN1 only, DH only, N2 only, and H3-JH only) each constitute theoretical segment pools.

Example 9.2

Exemplary Library Design 2 (ELD-2)

The inputs for this design are the HPS and the segments from TSP1 plus the novel TN1 and N2 segments extracted from the HPS (Example 7). The outputs are (1) 200 DH and 100 H3-JH segments, each from TSP1; and (2) 100 TN1 and 200 N2 segments including TN1 and N2 segments originally in TSP1 and those extracted from the sequences in the HPS. Applying the method described in Example 7 to extract novel TN1 and N2 segments (i.e., those not included in TSP1) resulted in the identification of 1,710 novel TN1 segments and 1,024 novel N2 segments. The segments corresponding to ELD-2 are provided in Table 24. Note that here the combination of all of the segments (i.e., TN1, DH, N2, and H3-JH), and the individual sets of segments (i.e., TN1 only, DH only, N2 only, and H3-JH only) each constitute theoretical segment pools. As in ELD-1, all segments in ELD-2 were selected for inclusion based solely on their usage weights in the HPS.

Example 9.3

Exemplary Library Design 3 (ELD-3)

The inputs for this design are identical to those for ELD-2. As in ELD-2, the outputs are (1) a set of 200 DH and 100

H3-JH segments, each from TSP1; and (2) a set of 100 TN1 and 200 N2 segments, including TN1 and N2 segments originally in TSP1 and those extracted from the sequences in the HPS (Example 7). However, the approach used for the selection of the segments for ELD-3 differs in two respects. First, selected physicochemical properties of the segments (hydrophobicity, isoelectric point, and alpha-helix propensity) were used, in addition to the segment usage weights, to prioritize segments for inclusion in the physical library. Hydrophobicity was used to de-prioritize hydrophobic DH segments that are empirically over-represented in poorly expressed antibodies isolated from yeast-based libraries. Isoelectric point and propensity for alpha-helix formation were utilized to identify segments located in regions of physicochemical property space that were relatively unexplored in CDRH3 libraries known in the art (e.g., U.S. Publication Nos. 2009/0181855 and 2010/0056386, and WO/2009/036379). Second, the segment usage weights were calculated via a bootstrap analysis of the HPS dataset. These methods are more fully described below. The segments corresponding to ELD-3 are provided in Table 25. Note that here the combination of all of the segments (i.e., TN1, DH, N2, and H3-JH), and the individual sets of segments (i.e., TN1 only, DH only, N2 only, and H3-JH only) each constitute theoretical segment pools.

Example 9.3.1

Generation of Segment Usage Weights Via Bootstrap Analysis

Bootstrap analysis (Efron & Tibshirani, *An Introduction to the Bootstrap*, 1994 Chapman Hill, New York) is a widely used statistical procedure for estimating the variability of a statistic of a given sample. This estimate is based on the value of the statistic calculated for several sub-samples, equal in size to the original sample and derived from it via sampling with replacement. Members of the original sample are chosen at random to form the sub-samples, and are typically included multiple times in each sub-sample (hence, "sampling with replacement").

Here, the original sample is the HPS dataset with n=3,571 members and the statistic is the segment usage weight. One-thousand sub-samples, each with 3,571 members, were generated by randomly choosing sequences from the HPS dataset (no more than 10 repeats of a given sequence were allowed in each sub-sample). The matching method described above was then applied to each sub-sample, and the final segment usage weights were calculated as the average of the values obtained for the individual sub-samples. Average values derived via this bootstrap procedure are more robust than values calculated from the parent HPS dataset alone. Unless indicated otherwise, these average values of the 1,000 sub-samples were used in the selection of segments for ELD-3.

Example 9.3.2

Amino Acid Property Indices

The AAindex database, available online at www.genome.ip/aaindex/, provides more than 500 numerical indices representing various physicochemical and biochemical properties of amino acids and pairs of amino acids. These properties include hydrophobicity, electrostatic behavior, secondary structure propensities and other characteristics, with several indices often available for a given property. The following three indices were chosen by starting with the well-understood Kyte-Doolittle hydropathy index (KYJT820101) and adding the indices most numerically de-correlated from it and each other. They thus potentially describe non-overlapping regions of amino acid property space and were used for analysis and selection of the DH and H3-JH segments for ELD-3:
1. KYTJ820101 (hydropathy index)
2. LEVM780101(normalized frequency of alpha helix)
3. ZIMJ680104 (isoelectric point)

Example 9.3.3

Figure 6:
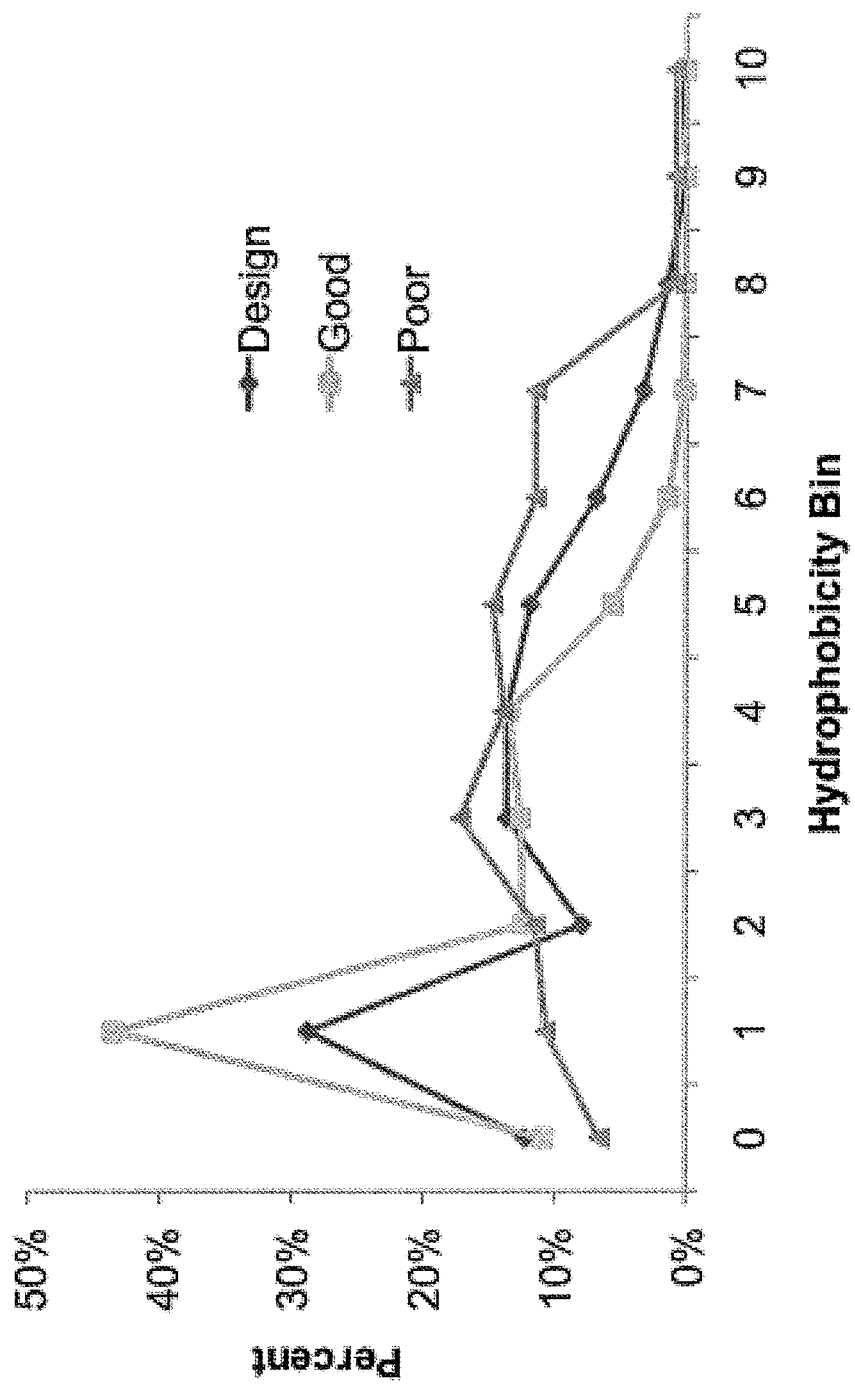
FIG. 6 shows the frequency of "Good" and "Poor" expressing CDRH3 sequences isolated from yeast-based libraries described in US 2009/0181855, and their comparison to the sequences contained in the library design described therein ("Design"), as a function of the DH segment hydrophobicity (increasing to the right).

Hydrophobic DH Segments are Over-Represented in Poorly Expressed Antibodies Isolated from Yeast-Based Libraries Based on protein expression levels from approximately 1200 antibodies expressed in *S. cerevisiae*, antibodies were classified as either "Good" or "Poor" expressors. The CDRH3 sequence of each antibody in each category was examined to identify sequence features that correlated with the expression level. One such sequence feature is the hydrophobicity of the DH segments calculated using the KYTJ820101 index. FIG. 6 provides the frequency of "Good" and "Poor" expressors as a function of the DH segment hydrophobicity (increasing to the right). The distribution expected from the synthetic library used to isolate these antibodies is also provided as a reference ("Design"). DH segments with the highest hydrophobicity values (far right of the plot) are over-represented (relative to the expectation based on the design) among "Poor" expressors and under-represented among "Good" expressors. Similarly, hydrophilic DH segments (far left) are over-represented among "Good" expressors and under-represented among "Poor" expressors. From this data, it was inferred that the overall expressibility of the antibodies of the library may be improved by synthesizing CDRH3 sequences with fewer hydrophobic DH segments.

Example 9.3.4

Selection of the 200 DH Segments for Inclusion in ELD-3

A set of 71 DH segments from TSP1 were designated as "core" DH segments for automatic inclusion in ELD-3. These segments had the following desirable properties:
1. Fifty-three of seventy-one were present within the top 7% of DH segments rank-ordered by segment usage weights from the bootstrap analysis.
2. Eighteen of seventy-one were present within the top 7% of DH segments rank-ordered by usage weights derived from antibodies isolated from libraries expressed in *S. cerevisiae*.

The remaining 1,040 segments were designated as "non-core." To complete the set of 200 segments in ELD-3, 129 segments were chosen from the "non-core" pool of segments in the following manner:
1. Sixty-five segments were eliminated because they contain either (a) an Asn residue at the last or next-to-last position with the potential to form N-linked glycosylation motifs via combination with N2 amino acids or (b) the amino acid sequence NG, implicated in de-amidation.
2. Segments with higher than median values for the KYTJ820101 hydropathy index (median=2.9 for 1K DH) were eliminated from further consideration. In view of the known importance of Tyr for antigen recognition (Fellouse et al., PNAS, 2004, 101: 12467; and Hofstadter et al., J. Mol. Biol., 1999, 285: 805, each incorporated by reference in its entirety), segments containing at least one Tyr residue were retained unless located in the highest hydrophobicity quartile (KYTJ820101 value higher than 9.4). This eliminated 443 segments.

3. The final set of 129 segments was obtained by using an objective function that aimed to maximize the Euclidean distance, between the "core" and the remaining 443 "non-core" segments, in a multi-dimensional space defined by the following variables: (1) amino acid mismatches to nearest neighbor; and (2) values of the three physicochemical property indices.

Example 9.3.5

Selection of the 100 H3-JH Segments for Inclusion in ELD-3

One-hundred H3-JH segments were chosen for inclusion in ELD-3 in the following manner.
1. Twenty-eight H3-JH segments were selected after being experimentally validated in other libraries containing only these H3-JH segments (see U.S. Publication Nos. 2009/0181855 and 2010/0056386, and WO/2009/036379).
2. Fifty-seven segments were selected based on their presence within the top 25% of H3-JH segments rank-ordered by usage weights from the bootstrap analysis described above. These 57 H3-JH segments, plus the 28 H3-JH segments of (1) (i.e., 85 segments total) were designated as the "core" H3-JH segments, which, like the core DH segments, were automatically included in ELD-3.
4. Fifteen additional segments were chosen by using an objective function that aimed to maximize the Euclidian distance, between the "core" and the remaining 200 "non-core" segments, in a multi-dimensional space defined by the following variables: (1) amino acid mismatches to nearest neighbor; and (2) values of the three physicochemical property indices.

Example 9.3.6

Selection of 100 TN1 and 200 N2 Segments for Inclusion in ELD-3

TN1 and N2 segments were extracted from the sequences in each sub-sample of the bootstrap procedure, and the 100 TN1 and 200 N2 segments with the highest average segment usage weights were chosen for inclusion into the library, after elimination of sequences with undesirable motifs, namely Cys and Asn residues.

Example 9.3.7

Selection of Nucleotide Sequences to Encode the Segments Chosen for Inclusion in ELD-3

Each of the polypeptide segments chosen for inclusion in the library must be back translated (polypeptide to DNA) into a corresponding oligonucleotide sequence. While a large number of oligonucleotides could possibly encode each polypeptide segment, due to the degeneracy of the genetic code, certain constraints were imposed to select oligonucleotides that were more desirable. First, since ELD-3 was expressed in yeast (*S. cerevisiae*), codons that are rarely used in yeast were avoided. For example, of the six possible codons for Arg, three: CGA, CGC and CGG are used to encode yeast proteins at rates of under 10% (see, for example, Nakamura et al., Nucleic Acids Res., 2000, 28:292), and therefore those three codons were avoided to the extent possible. Second, since many antibodies are produced in Chinese Hamster Ovary (CHO) cells (after discovery e.g., in yeast), the CCG codon (encoding Pro) was also avoided, since it is rarely used by hamsters (Nakamura et al.)

A number of restriction enzymes are employed during the actual construction of the CDRH3 oligonucleotide library (see Example 10 of U.S. Pub. No. 2009/0181855). It is thus desirable to avoid the occurrence of recognition motifs for these restriction enzymes within the CDRH3 polynucleotide sequences. Codons are selected at the individual segment level to avoid introducing recognition motifs for restriction enzymes that may be used downstream. Since such motifs may also be generated by combinatorial assembly of the segments, the segment combinations are also checked and, whenever possible, codons are changed to eliminate the occurrence of such motifs. Specifically, three restriction enzymes were used during the construction of the currently exemplified CDRH3 library: BsrDI, BbsI, and AvrII. The first two are type II enzymes with non-palindromic recognition sites. The reverse strand of the oligonucleotides encoding the segments was checked explicitly for recognition sites for these two enzymes. In particular, the reverse strands were checked for the motifs GCAATG and CATTGC (for BsrDI) and GAAGAC and GTCTTC (for BbsI). The recognition motif for AvrII is palindromic so the oligonucleotides were only checked for the sequence CCTAGG. However, AvrII is used only to treat TN1 segments, and thus it is not necessary to evaluate its presence in the other segments or their combinations.

An additional constraint that was imposed to improve engineering of the polypeptide to polynucleotide conversion was avoidance of consecutive runs of 6 or more of the same type of base, as this is believed to increase errors during solid phase oligonucleotide synthesis. Therefore, DNA sequences for the segments of ELD-3 were chosen to avoid such motifs. The DNA sequences for the ELD-3 segments are included, with the respective polypeptide sequences, in Table 25. One of ordinary skill in the art will readily recognize that these methods can also be applied to any other library, any restriction sites, any number of nucleotide repeats, and/or to avoid the occurrence of any codons considered undesirable in any organism.

Example 10

Matching of ELD-3 to Human CDRH3 Datasets and Clinically Relevant Antibodies

Among the objectives of the invention is to mimic the V-D-J recombination processes underlying the creation of the human CDRH3 repertoire in vivo, thereby increasing the diversity of the CDRH3 library in comparison to other libraries known in the art, while maintaining the human character of CDRH3. One measure of success is the extent to which collections of human reference CDRH3 sequences are represented identically, or via close matches (e.g., less than about 5, 4, 3, or 2 amino acid differences) in any library of the invention. We evaluated this metric using two human CDRH3 sequence reference datasets, both non-overlapping with each other and the HPS: (1) a collection of 666 human CDRH3 sequences (Lee et al., Immunogenetics, 2006, 57: 917; "Lee-666"); and (2) a collection of 3,000 human CDRH3 sequences randomly chosen from the over 200,000 sequences disclosed in Boyd et al., Science Translational Medicine, 2009, 1: 1-8 ("Boyd-3000"). The results of the random sample of the 3,000 human CDRH3 sequences from Boyd et al. was representative of the results of the same analysis as applied to all members of the Boyd et al. set (>200,000 CDRH3 sequences).

Figure 7:
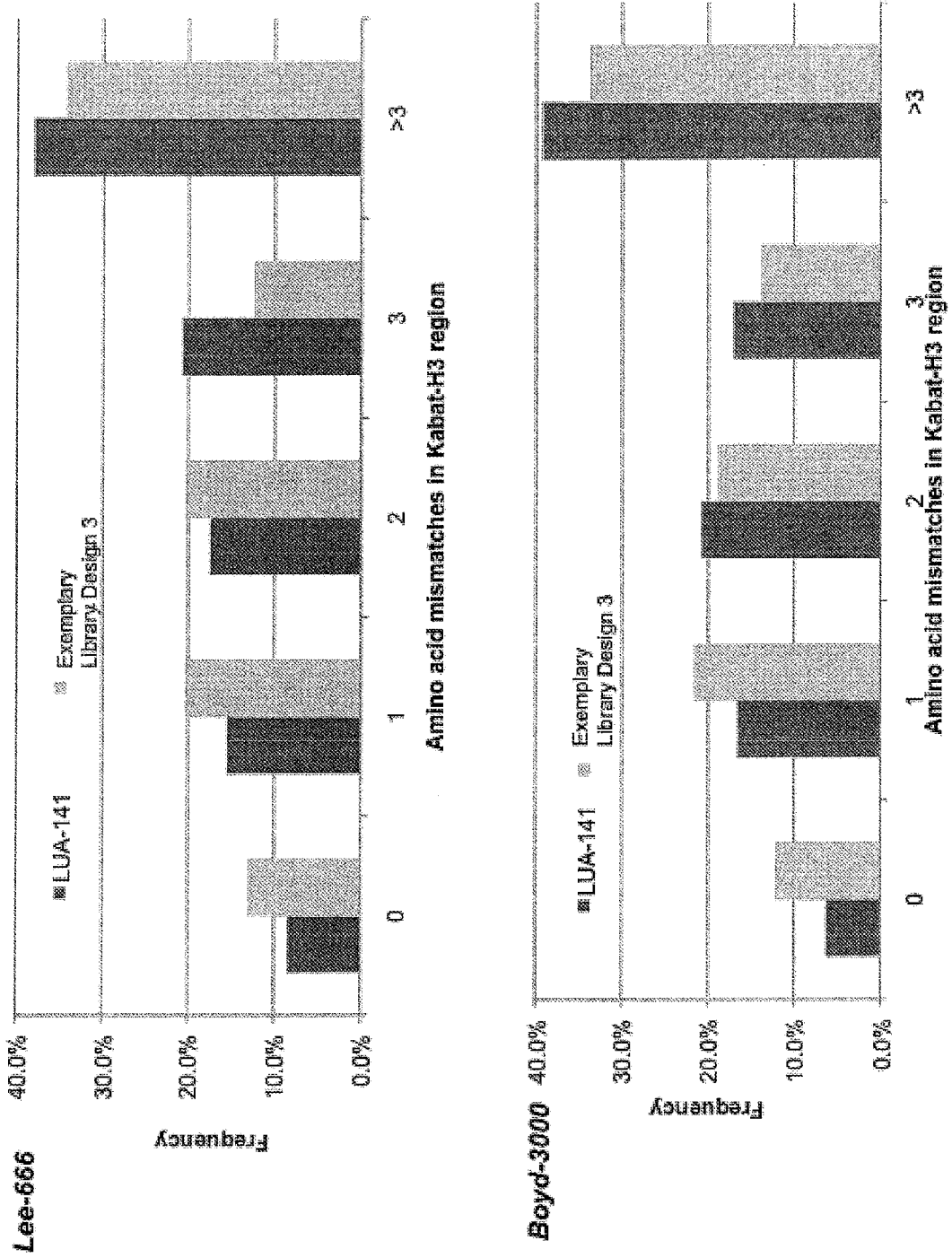
FIG. 7 shows the percentage of CDRH3 sequences in the LUA-141 library and Exemplary Library Design 3 (ELD-3) that match CDRH3 sequences from Lee-666 and Boyd-3000 with zero, one, two, three, or more than three amino acid mismatches.

FIG. 7 provides the percentage of CDRH3 sequences in two synthetic libraries, "LUA-141" and ELD-3, that match a sequence from the Lee-666 or Boyd-3000 sets with zero, one, two, three, or more than three amino acid mismatches. Here, "LUA-141" represents a library containing 212 TN1, 278 DH, 141 N2, and 28 H3-JH (see U.S. Publication No. 2009/0181855 for details). In particular, it is notable that ELD-3 exhibits a higher percentage of sequences (12.9% and 12.1% for the Lee-666 and Boyd-3000 sets, respectively) that identically match a reference CDRH3 sequence than LUA-141 (8.4% and 6.3% for the Lee-666 and Boyd-3000 sets, respectively). It is also notable that ELD-3 exhibits a higher cumulative percentage of human CDRH3 sequences found with no more than two amino acid mismatches (54.1% and 52.5% for the Lee-666 and Boyd-3000 sets, respectively) relative to LUA-141 (41.2% and 43.7% for the Lee-666 and Boyd-3000 sets, respectively).

Another metric by which antibody libraries can be evaluated is their ability to match "clinically relevant" reference CDRH3 sequences. FIG. 8 demonstrates that ELD-3 returns better matches to clinically relevant CDRH3 sequences than the LUA-141 library. Specifically, ELD-3 matches 34 of 55 (62%) clinically validated antibodies within one amino acid, while the LUA-141 library only matches 20 of 55 (37%).

Example 11

Comparison of ELD-3 to LUA-141

Figure 9:
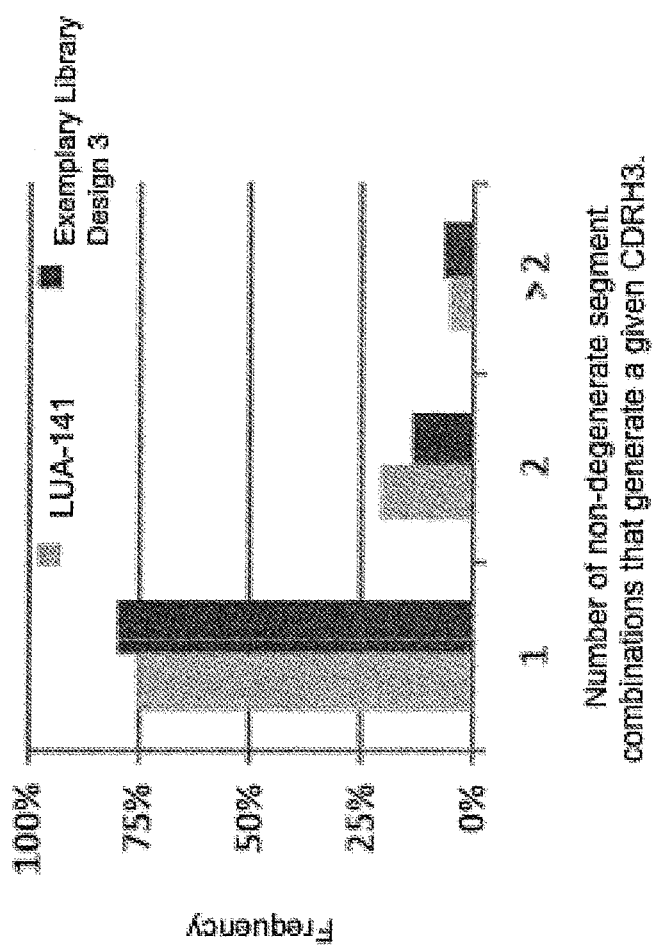
FIG. 9 shows that the combinatorial efficiency of Exemplary Library Design 3 (ELD-3) is greater than that of the LUA-141 library. Specifically, the ELD-3 segments are more likely to yield a unique CDRH3 than the LUA-141 library segments.

ELD-3 has 73 TN1, 92 DH, 119 N2, and 28 H3-JH in common with LUA-141. Thus, 94.5% of the sequences in ELD-3 ($4.0 \times 10^8$ members) are different from the LUA-141 library ($2.3 \times 10^8$ members). FIG. 9 demonstrates that the combinatorial efficiency of the segments in ELD-3 is greater than that of the segments in LUA-141. Specifically, the ELD-3 segments are more likely to yield a unique CDRH3 than the LUA-141 library segments. This is advantageous, because it allows one to synthesize libraries with increased CDRH3 diversity using fewer segments.

Figure 10:
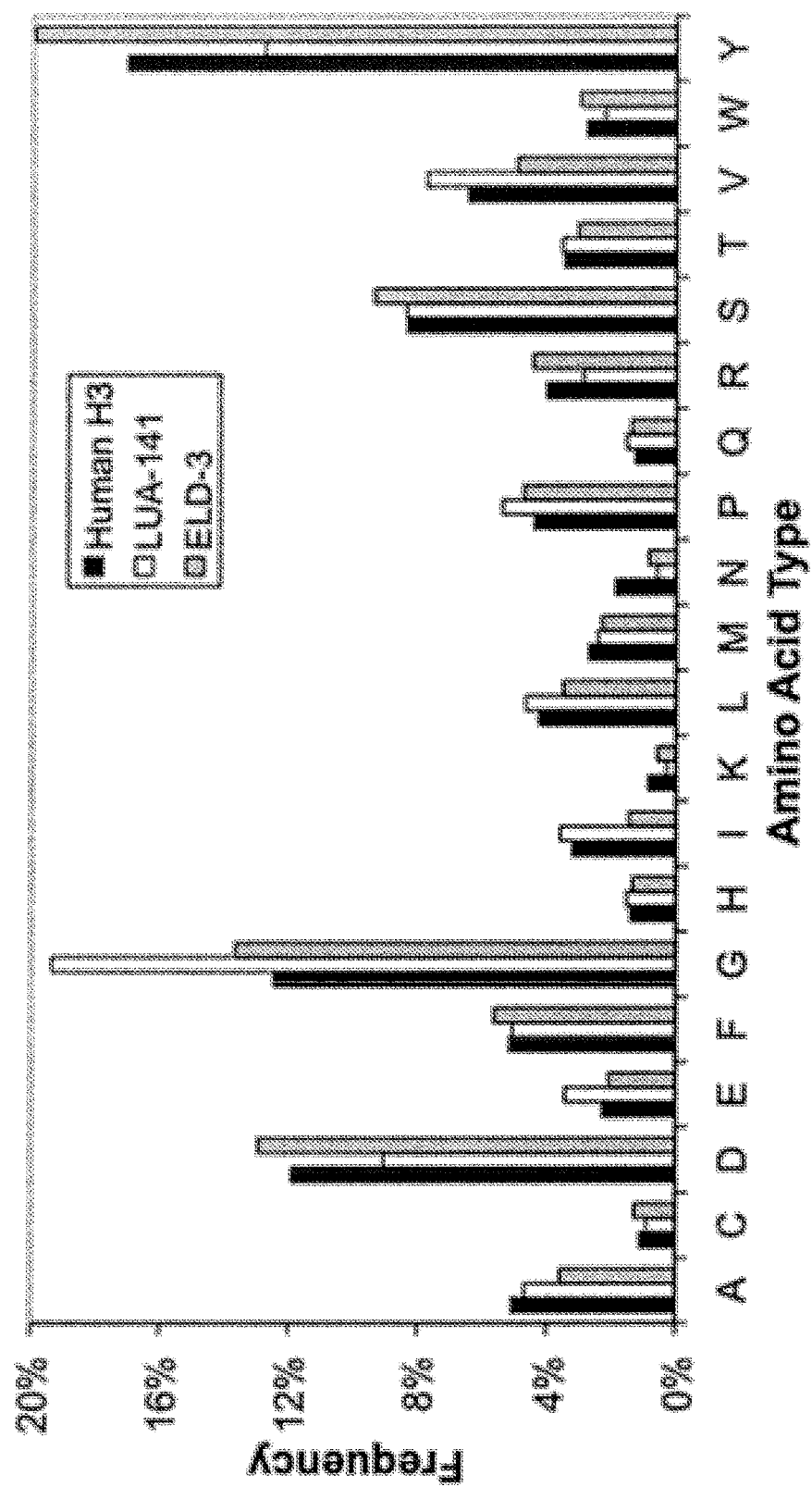
FIG. 10 shows the amino acid compositions of the Kabat-CDRH3s of LUA-141, Exemplary Library Design 3 (ELD-3), and Human CDRH3 sequences from the HPS (Human H3).

FIG. 10 provides the amino acid compositions of the Kabat-CDRH3s of LUA-141, ELD-3, and Human CDRH3 sequences from the HPS.

Figure 11:
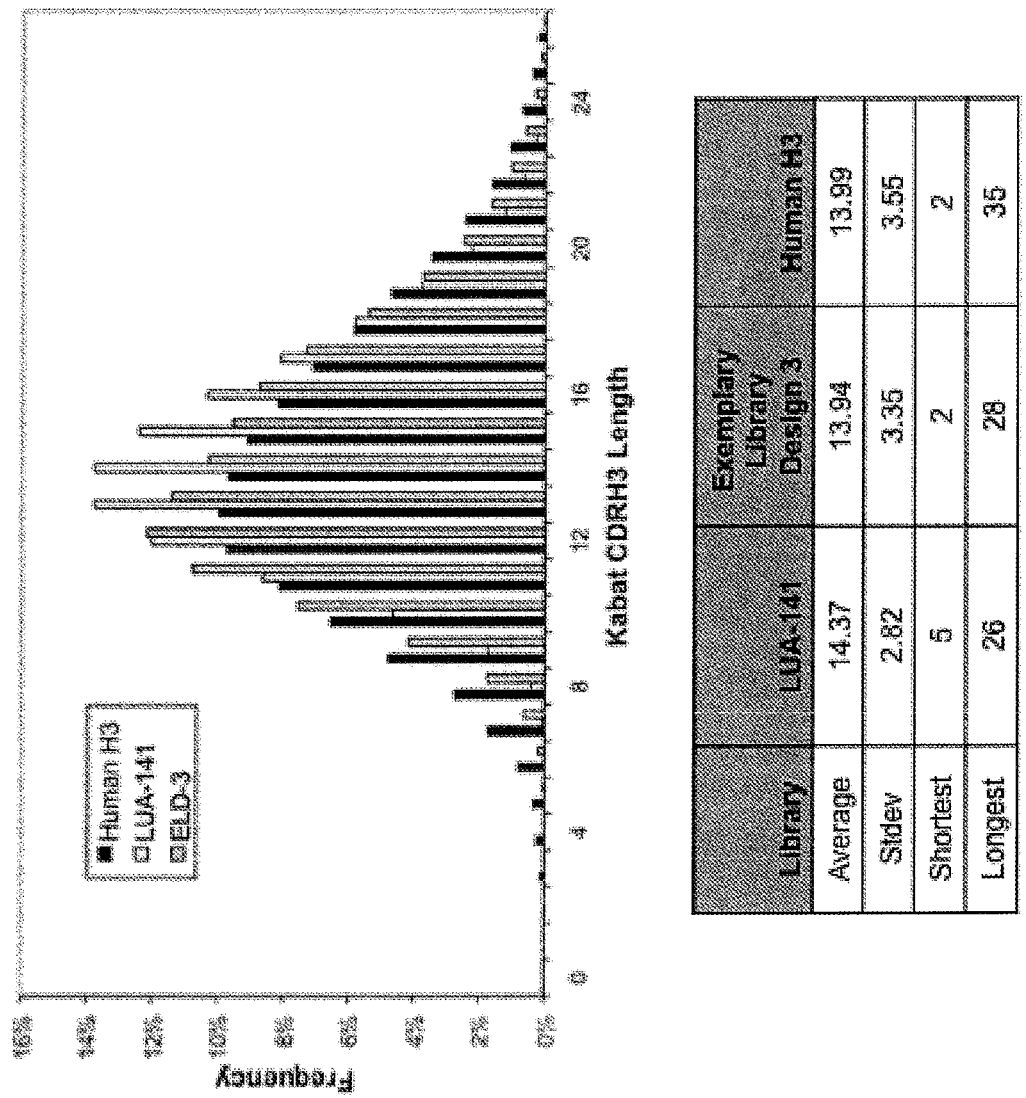
FIG. 11 shows the Kabat-CDRH3 length distribution of LUA-141, Exemplary Library Design 3 (ELD-3), and Human CDRH3 sequences from the HPS (Human H3).

FIG. 11 provides the Kabat-CDRH3 length distribution of LUA-141, ELD-3, and Human CDRH3 sequences from the HPS.

CDRH3 Libraries Synthesized with Degenerate Oligonucleotides

Example 12

Further Increasing CDRH3 Diversity by Utilizing Degenerate Oligonucleotides

The methods described in this example extend the methods taught above, to produce CDRH3 libraries with more members than those of the libraries described above. In particular, one or two degenerate codons were introduced into the DH and or N2 polynucleotide segments, and (generally) no degenerate codon or one degenerate codon were introduced into the H3-JH segments. Segments with different numbers of degenerate codons are also contemplated; for example DH segments with 0, 1, 2, 3, 4, 5, 6, 7, 8, or more degenerate codons, and H3-JH segments with 0, 1, 2, 3, 4, 5, or more degenerate codons. This results in CDRH3 libraries containing greater than about $10^{11}$ (about $2 \times 10^{11}$) distinct CDRH3 amino acid sequences that closely reflect properties, such as length and composition among others, of a reference set of human CDRH3 sequences. As described below, the degenerate positions in the DH segments are usually, but not always, the very N- and/or C-terminal positions, or 5' and 3' end codons (i.e., not necessarily only the first or last base), respectively, when considering the corresponding oligonucleotide sequences. Degenerate codons were similarly used to synthesize N2 segments. Two hundred of the TN1 segments were as described in ELD-3, although libraries with degenerate TN1 segments, or with alternative choices of TN1 segment sequences, fall within the scope of the invention. An additional one hundred TN1 segments complete the set of 300 TN1 segments for this library. The amino acid and nucleotide sequences are listed in Table 26. It is also possible to use mixtures of trinucleotides instead of, or in addition to, degenerate oligonucleotides in order to allow amino acid type variation at one or more selected positions within "base" or "seed" segment sequences (defined below).

Example 13

Selection of DH Segments for Synthesis by Degenerate Oligonucleotides

The segment usage weights were calculated for the 68K DH Theoretical Segment Pool by comparison to the sequences contained in Boyd et al. The DH segments with a length of three or more amino acids were ranked according to their segment usage weights (as described above), and the top 201 were designated as "seed" sequences. These seed sequences were then varied by selecting certain positions to incorporate degenerate codons. The positions selected for variance, the amino acids types to which they were varied, were determined by comparing the seed sequences to a reference set of 9,171 DH segments that were a subset of the 68K DH Theoretical Segment Pool. These 9,171 DH segments were selected because their segment usage weight in Boyd et al. was significant, meaning that the cumulative segment usage weight (Example 8) is at least 1.0.

Each of the 201 seed sequences was compared to each of the sequences in the reference set of 9,171 DH segments, and those of identical length and differing at a single position were further considered to inform possible variants of the seed. In this manner, the most variable position for each seed was identified and a set of candidate amino acid types was also identified for each position. Finally, a set of degenerate codons was considered, to identify the codon that most faithfully represented the set of candidate amino acid types for each particular position. Degenerate codons encoding stop codons, Cys residues, N-linked glycosylation motifs (i.e., NXS or NXT, where X is any amino acid type), or deamidation motifs (NG) were eliminated from consideration. This process generated 149 unique degenerate oligonucleotide sequences, which collectively encode 3,566 unique polypeptide sequences. Alternative designs generated according to the same principles were also considered, and those having a larger diversity (in terms of the number of unique polypeptide sequences) and smaller RMAX values (see below) were given preference for inclusion in the libraries of the invention. However, it is also conceivable that different criteria could be used to select DH segments from the 68K DH Theoretical Segment Pool, and that libraries including DH segments selected by these different criteria would also fall within the scope of the invention.

Because not all degenerate oligonucleotides encode an identical number of polypeptides, the latter do not occur with uniformly identical weights over the entirety of a given theoretical segment pool (i.e., TN1, DH, N2 and H3-JH) contained within a CDRH3 library of the invention. For example, an individual amino acid sequence X encoded by an oligonucleotide of total degeneracy 4 will have a "weight" of ¼, while another individual amino acid sequence, Y, encoded by an oligonucleotide of degeneracy 6 will have a weight of ⅙. Moreover, certain amino acid sequences could be encoded by more than one degenerate oligonucleotide, so their weights will be the sum of the individual contributions by each oligonucleotide. Within a given theoretical segment pool, the ratio of the weight of the most heavily weighted polypeptide to that of the least heavily weighted one, RMAX, is an important design criterion that one would ideally like to minimize. The RMAX value may be defined by length, or overall for all of the segments of any given type (i.e., all the DH segments, or all the H3-JH segments, and so on for the TN1, and/or the N2 segments). Table 27 lists the degenerate oligonucleotide sequences, while Table 28 lists the unique polypeptide sequences resulting from these oligonucleotides. These two tables include the DH dimer segments the design of which is detailed below.

Example 13.1

Selection of DH Dimer Segments

A different method was employed to design a set of degenerate oligonucleotides encoding DH dimer sequences. The method aimed to include all of the 45 dimer sequences in ELD-3 plus as many of the other 400 theoretically possible dimer sequences (i.e., 20 residues possible in each of 2 positions=20*20), minus segments containing Asn (N) residues and excessively hydrophobic dimers (i.e., any dimer combination comprising only F, I, L, M, and/or V residues). This design process ultimately yielded 35 degenerate oligonucleotide sequences encoding 213 unique peptide dimer sequences. As with the selection processes used for all of the other segments of the invention, one or ordinary skill in the art will readily recognize that other criteria could be used to select the DH dimer segments, and that libraries including these segments also fall within the scope of the invention.

Combining the DH dimer segments with the longer DH segments of Example 13, yielded the final set of DH segments of the currently exemplified library, encoded by a total of 184 oligonucleotides (35 encoding dimers and 149 encoding segments having three or more amino acids) versus the 200 oligonucleotides of ELD-3. The 184 oligonucleotides encode a total of 3,779 unique polypeptide sequences: 213 dimers and 3,566 longer segments of three amino acids or greater.

Example 14

Generation of Expanded N2 Diversity

As described above, ELD-3 contains 200 N2 segments. In the currently exemplified library, the empty N2 segment (i.e., no N2, so that the DH segments are joined directly to the H3-JH segments) and monomer N2 segments were the same as in ELD-3. However, degenerate oligonucleotides were used to generate sets of two-, three-, and four-mers that not only recapitulated all of the corresponding sequences in ELD-3 but also resulted in additional diversity. As with the DH segments, these degenerate oligonucleotides were designed to eliminate Asn (in unsuitable positions) and Cys residues, and stop codons. More specifically, Asn residues were allowed at the first position of trimers and at the first or second position of tetramers whenever the subsequent amino acid was not Gly and the next amino acid was not Ser or Thr, thus avoiding deamidation or N-linked glycosylation motifs within the candidate N2 segments. The N2 theoretical segment pool for the currently exemplified library contains one zero-mer (i.e., no N2 segment), 18 monomer, 279 dimer, 339 trimers, and 90 tetramer N2 amino acid sequences, or 727 segments in total. These amino acid sequences are encoded by 1, 18, 81, 36, and 10 oligonucleotides, respectively, for a total of 146 oligonucleotides. All but the first 19 oligonucleotides, those encoding the zero- and one-mers, are degenerate. Table 29 lists the 146 oligonucleotide sequences, while Table 30 lists the resulting 727 unique polypeptide sequences.

Example 15

Generation of Expanded H3-JH Diversity

Application of nucleotide-level progressive deletions on the 5' end of the human IGHJ polynucleotide segments down to the point where only the DNA sequence corresponding to FRM4 remained (i.e., no H3-JH remained), followed by systematic 1- or 2-bp completions on the same 5' end, resulted in 643 unique H3-JH peptide segments after translation ("643 H3-JH Set"). As done with the DH segments, it is possible to rank order each of the 643 segments by their usage weights obtained after comparison to the approximately 237,000 human sequences from Boyd et al., and the top 200 individual sequences, from those devoid of the undesired motifs described above, were chosen to provide the set of H3-JH segments for the currently exemplified library.

In an alternatively exemplified embodiment, 46 of the 200 H3-JH segments were designed with a two-fold degenerate codon in the first position (i.e., N-terminal or 5' end, respectively, at the peptide and oligonucleotide level), so that, overall, 200 oligonucleotides would encode 246 unique peptide sequences.

In yet other alternatively exemplified embodiments, further use of degenerate codons may be conceived to produce libraries encoded by 90, 100, 200 or more oligonucleotides representing up to 500 distinct polypeptide sequences. Preferably, but not necessarily, these up to 500 unique sequences could be a subset of the sequences in the 643 H3-JH reference set described above, or a subset of variants of these sequences. As exemplified above, H3-JH segments containing undesirable polypeptide motifs may be eliminated from the design. The oligonucleotide sequences for the JH segments are listed on Table 31, while the resulting unique polypeptide sequences are provided in Table 32. In Table 31, nucleotide sequences corresponding to the FRM4 region are also provided, but the "peptide length" value refers to the H3-JH portion only. For simplicity, only the H3-JH peptide sequences are included in Table 32.

Example 16

Extended Diversity Library Design (EDLD)

The TN1, DH, H3-JH, and N2 segments selected above, and provided in Tables 26 to 32, were combined to generate an Extended Diversity Library Design (EDLD) with theoretical diversity of about $2 \times 10^{11}$ (300 TN1×3,779 DH×727 N2×246

H3-JH). The oligonucleotides encoding the selected segments were chosen according to the principles of Example 9.3.7.

Figure 12:
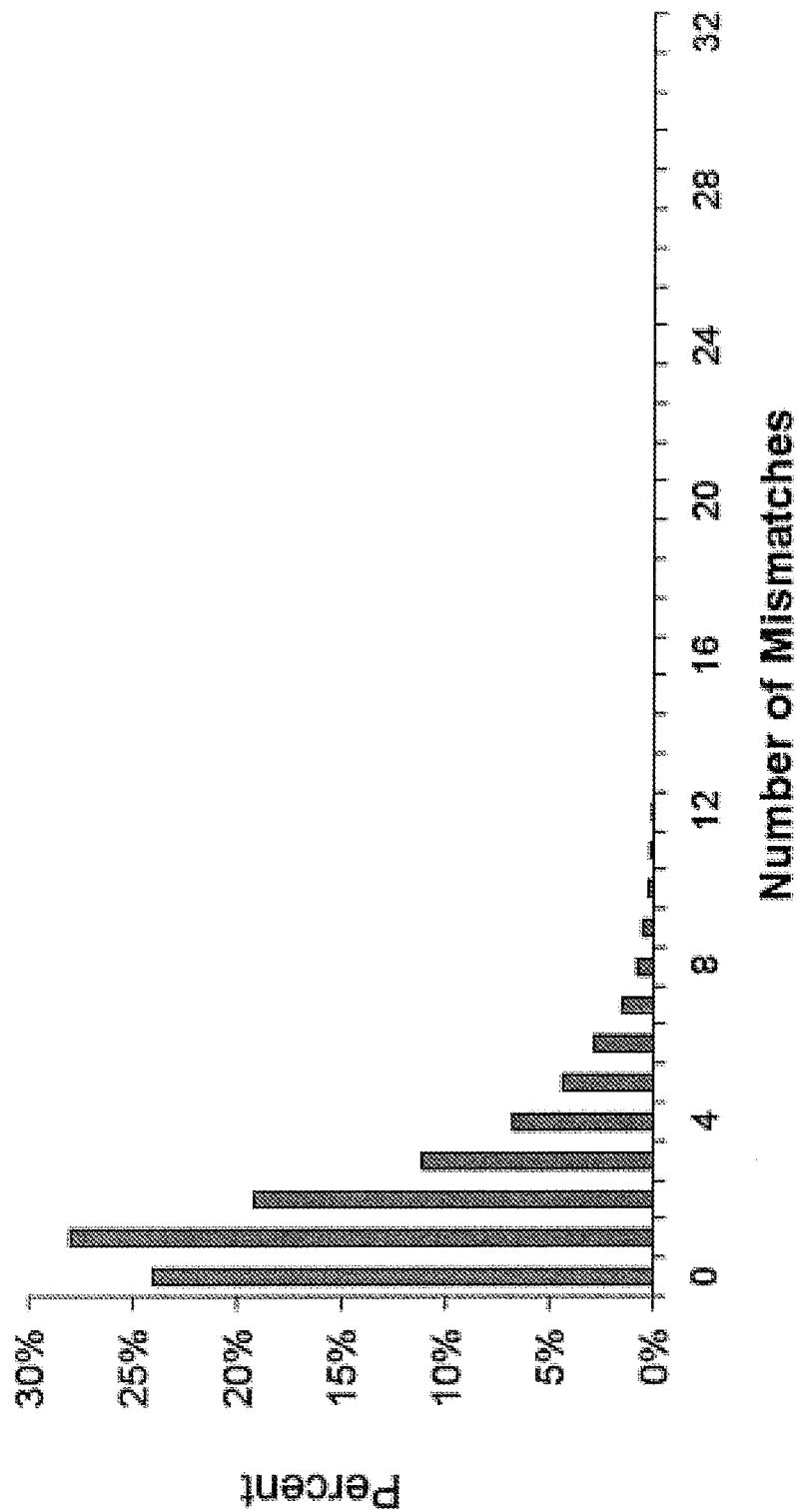
FIG. 12 shows the percentage of CDRH3 sequences in the Extended Diversity library that match CDRH3 sequences from Boyd et al. with zero to thirty-two amino acid mismatches
Figure 13:
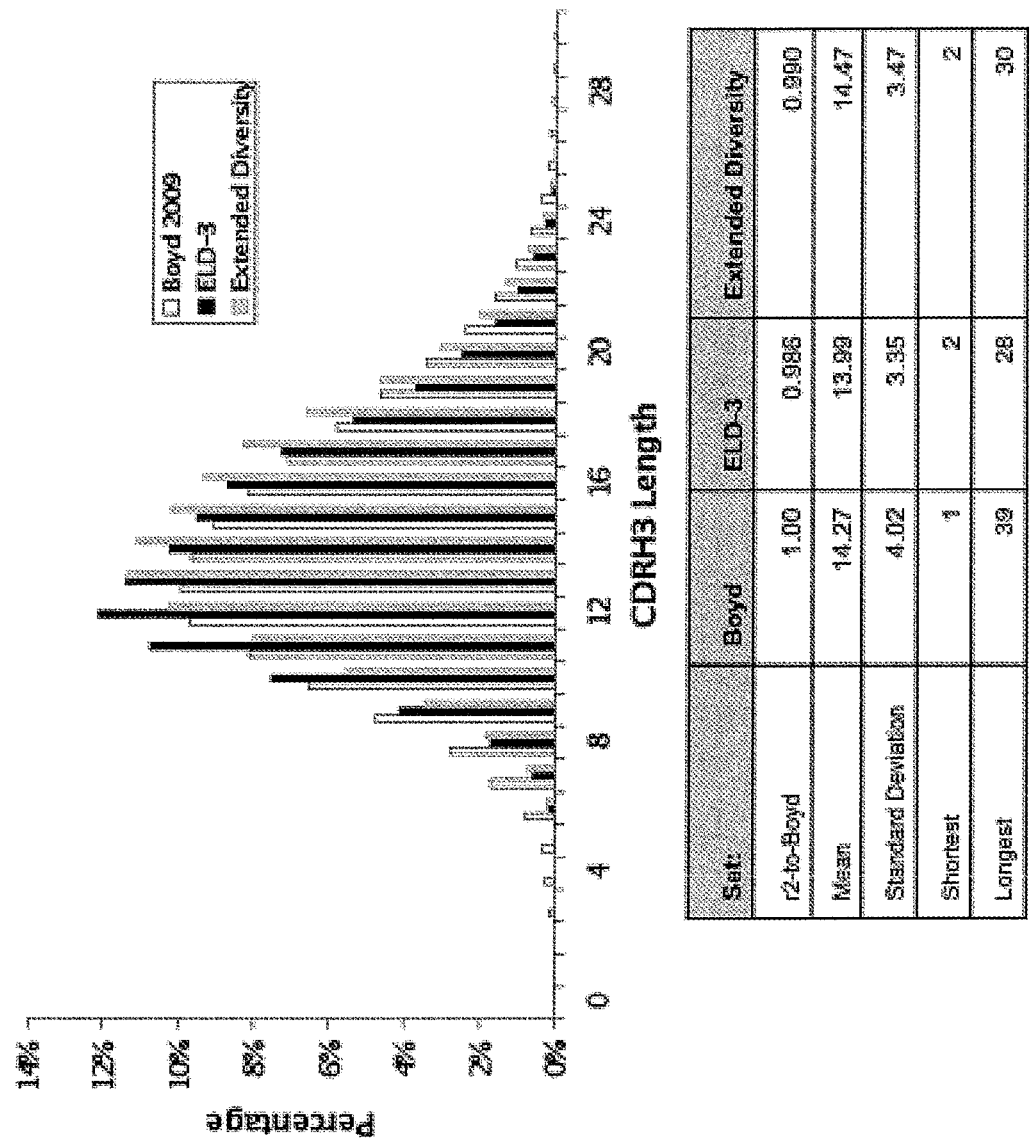
FIG. 13 shows the Kabat-CDRH3 length distribution of Exemplary Library Design 3 ("ELD-3"), the Extended Diversity Library Design ("Extended Diversity") and human CDRH3 sequences from the Boyd et al. data set ("Boyd 2009").
Figure 14:
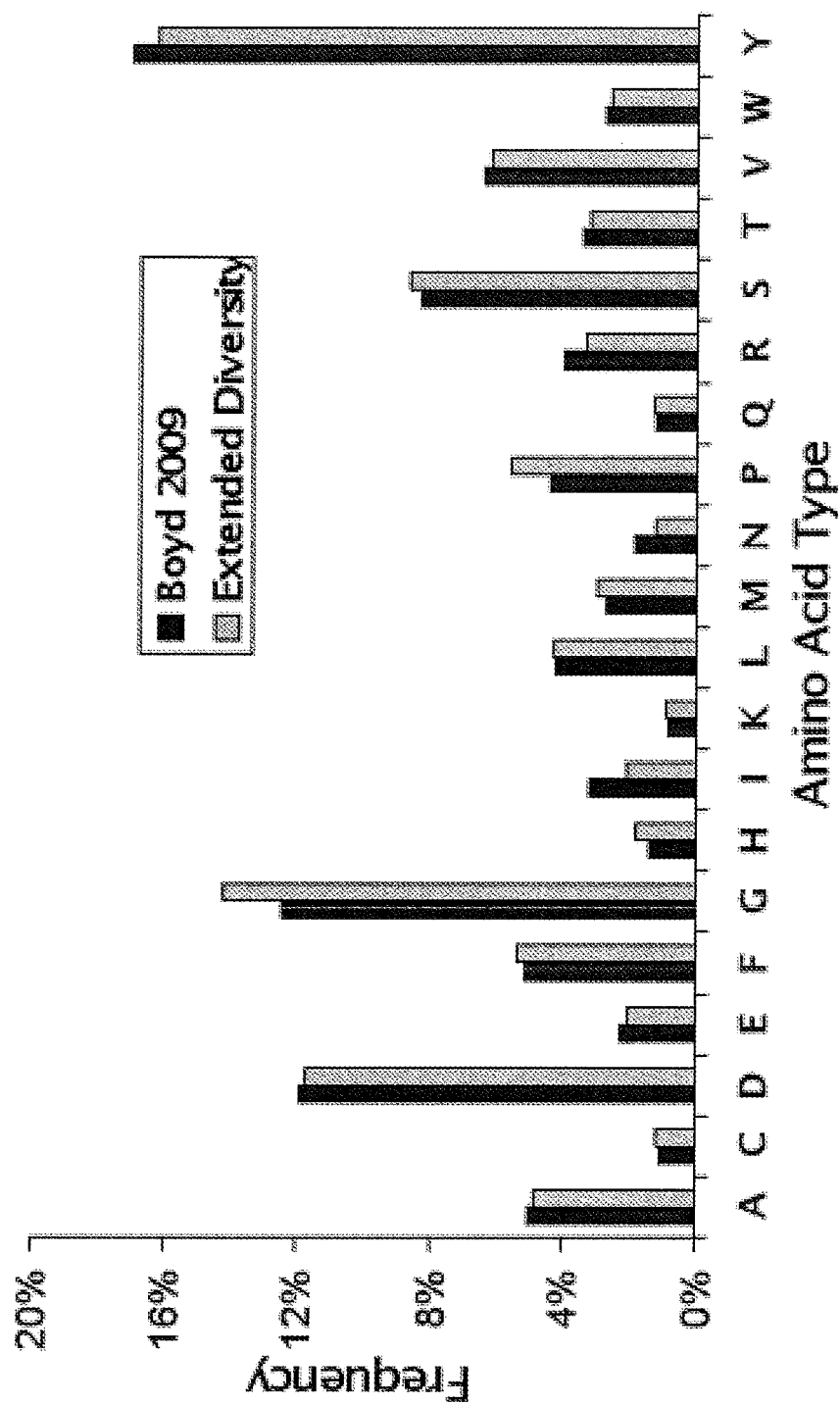
FIG. 14 shows the amino acid compositions of the Kabat-CDRH3s of the Extended Diversity Library Design ("Extended Diversity") and human CDRH3 sequences from the Boyd et al. dataset ("Boyd 2009").
Figure 15:
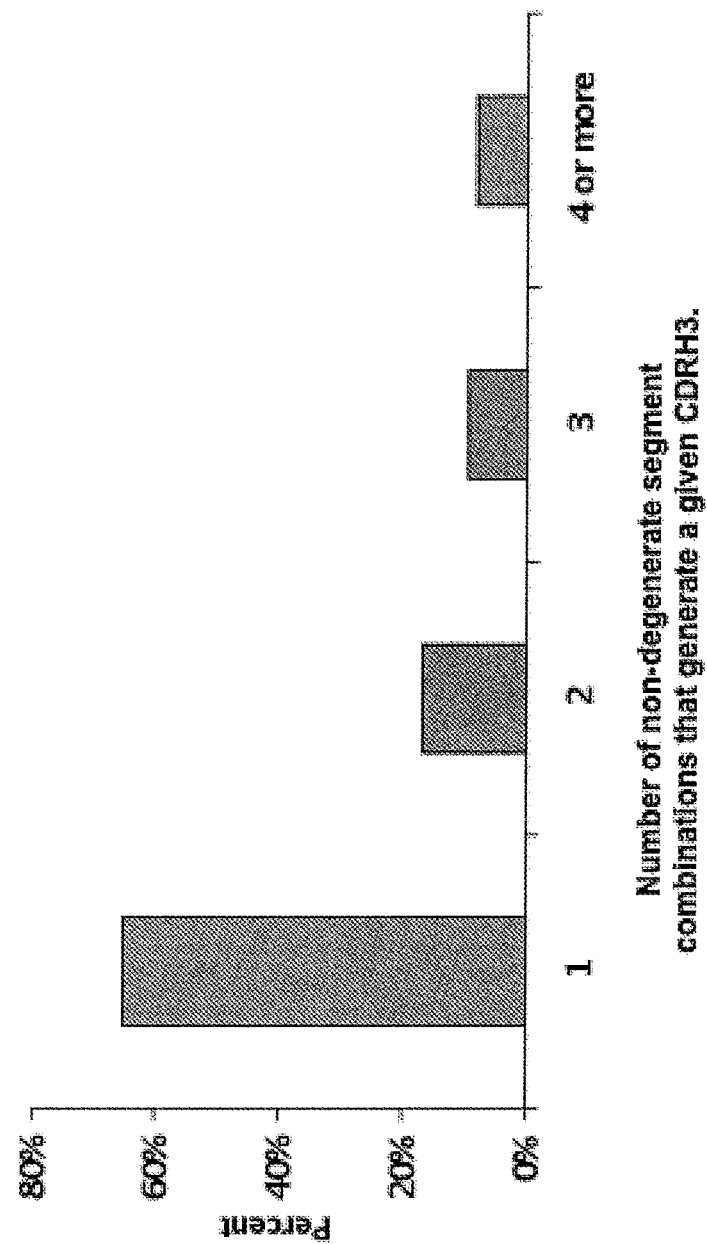
FIG. 15 shows the combinatorial efficiency of the Extended Diversity Library Design by matching 20,000 randomly selected sequences from the (same) design. About 65% of the sequences appear only once in the design and about 17% appear twice.

FIGS. 12-15 illustrate certain characteristics of this design indicating, for example, that about 50% of the approximately 237,000 CDRH3 sequences in Boyd et al. may be recapitulated by library sequences with either one or no mismatches (i.e., by summing the "0" and "1" bins of FIG. 12). The theoretical length distributions (FIG. 13) and amino acid compositions (FIG. 14) of these libraries also match closely the respective characteristics observed in the same set of human CDRH3 sequences. FIG. 15 shows the combinatorial efficiency of the Extended Diversity Library Design. Approximately 65% of the sequences appear only once in the design (i.e., are generated via one non-degenerate combination of segments). FIG. 8, previously presented, shows that the Extended Diversity Library Design outperforms both LUA-141 and ELD-3 in terms of matching to clinically relevant human antibody sequences.

TABLE 1

Germline-like sequences for eight of the VK chassis provided by the invention.

| Germline | Junction | Germline-Like CDRL3 Sequence | SEQ ID NO |
| --- | --- | --- | --- |
| VK1-05 | 1 | QQYNSYST | 1 |
| VK1-05 | 2 | QQYNSYFT | 2 |
| VK1-05 | 3 | QQYNSYLT | 3 |
| VK1-05 | 4 | QQYNSYIT | 4 |
| VK1-05 | 5 | QQYNSYRT | 5 |
| VK1-05 | 6 | QQYNSYWT | 6 |
| VK1-05 | 7 | QQYNSYYT | 7 |
| VK1-05 | 8 | QQYNSYSPT | 8 |
| VK1-05 | 9 | QQYNSYSFT | 9 |
| VK1-05 | 10 | QQYNSYSLT | 10 |
| VK1-05 | 11 | QQYNSYSIT | 11 |
| VK1-05 | 12 | QQYNSYSRT | 12 |
| VK1-05 | 13 | QQYNSYSWT | 13 |
| VK1-05 | 14 | QQYNSYSYT | 14 |
| VK1-05 | 15 | QQYNSYSPFT | 15 |
| VK1-05 | 16 | QQYNSYSPLT | 16 |
| VK1-05 | 17 | QQYNSYSPIT | 17 |
| VK1-05 | 18 | QQYNSYSPRT | 18 |
| VK1-05 | 19 | QQYNSYSPWT | 19 |
| VK1-05 | 20 | QQYNSYSPYT | 20 |
| VK1-12 | 1 | QQANSFPT | 21 |
| VK1-12 | 2 | QQANSFFT | 22 |
| VK1-12 | 3 | QQANSFLT | 23 |
| VK1-12 | 4 | QQANSFIT | 24 |
| VK1-12 | 5 | QQANSFRT | 25 |
| VK1-12 | 6 | QQANSFWT | 26 |
| VK1-12 | 7 | QQANSFYT | 27 |
| VK1-12 | 8 | QQANSFPPT | 28 |
| VK1-12 | 9 | QQANSFPFT | 29 |
| VK1-12 | 10 | QQANSFPLT | 30 |
| VK1-12 | 11 | QQANSFPIT | 31 |
| VK1-12 | 12 | QQANSFPRT | 32 |
| VK1-12 | 13 | QQANSFPWT | 33 |
| VK1-12 | 14 | QQANSFPYT | 34 |
| VK1-12 | 15 | QQANSFPPFT | 35 |
| VK1-12 | 16 | QQANSFPPLT | 36 |
| VK1-12 | 17 | QQANSFPPIT | 37 |
| VK1-12 | 18 | QQANSFPPRT | 38 |
| VK1-12 | 19 | QQANSFPPWT | 39 |
| VK1-12 | 20 | QQANSFPPYT | 40 |
| VK1-33 | 1 | QQYDNLPT | 41 |
| VK1-33 | 2 | QQYDNLFT | 42 |
| VK1-33 | 3 | QQYDNLLT | 43 |
| VK1-33 | 4 | QQYDNLIT | 44 |
| VK1-33 | 5 | QQYDNLRT | 45 |
| VK1-33 | 6 | QQYDNLWT | 46 |
| VK1-33 | 7 | QQYDNLYT | 47 |
| VK1-33 | 8 | QQYDNLPPT | 48 |
| VK1-33 | 9 | QQYDNLPFT | 49 |
| VK1-33 | 10 | QQYDNLPLT | 50 |
| VK1-33 | 11 | QQYDNLPIT | 51 |
| VK1-33 | 12 | QQYDNLPRT | 52 |
| VK1-33 | 13 | QQYDNLPWT | 53 |
| VK1-33 | 14 | QQYDNLPYT | 54 |
| VK1-33 | 15 | QQYDNLPPFT | 55 |
| VK1-33 | 16 | QQYDNLPPLT | 56 |
| VK1-33 | 17 | QQYDNLPPIT | 57 |
| VK1-33 | 18 | QQYDNLPPRT | 58 |
| VK1-33 | 19 | QQYDNLPPWT | 59 |
| VK1-33 | 20 | QQYDNLPPYT | 60 |
| VK1-39 | 1 | QQSYSTPT | 61 |
| VK1-39 | 2 | QQSYSTFT | 62 |

TABLE 1-continued

Germline-like sequences for eight of the VK chassis provided by the invention.

| Germline | Junction | Germline-Like CDRL3 Sequence | SEQ ID NO |
|---|---|---|---|
| VK1-39 | 3 | QQSYSTLT | 63 |
| VK1-39 | 4 | QQSYSTIT | 64 |
| VK1-39 | 5 | QQSYSTRT | 65 |
| VK1-39 | 6 | QQSYSTWT | 66 |
| VK1-39 | 7 | QQSYSTYT | 67 |
| VK1-39 | 8 | QQSYSTPPT | 68 |
| VK1-39 | 9 | QQSYSTPFT | 69 |
| VK1-39 | 10 | QQSYSTPLT | 70 |
| VK1-39 | 11 | QQSYSTPIT | 71 |
| VK1-39 | 12 | QQSYSTPRT | 72 |
| VK1-39 | 13 | QQSYSTPWT | 73 |
| VK1-39 | 14 | QQSYSTPYT | 74 |
| VK1-39 | 15 | QQSYSTPPFT | 75 |
| VK1-39 | 16 | QQSYSTPPLT | 76 |
| VK1-39 | 17 | QQSYSTPPIT | 77 |
| VK1-39 | 18 | QQSYSTPPRT | 78 |
| VK1-39 | 19 | QQSYSTPPWT | 79 |
| VK1-39 | 20 | QQSYSTPPYT | 80 |
| VK4-01 | 1 | QQYYSTPT | 81 |
| VK4-01 | 2 | QQYYSTFT | 82 |
| VK4-01 | 3 | QQYYSTLT | 83 |
| VK4-01 | 4 | QQYYSTIT | 84 |
| VK4-01 | 5 | QQYYSTRT | 85 |
| VK4-01 | 6 | QQYYSTWT | 86 |
| VK4-01 | 7 | QQYYSTYT | 87 |
| VK4-01 | 8 | QQYYSTPPT | 88 |
| VK4-01 | 9 | QQYYSTPFT | 89 |
| VK4-01 | 10 | QQYYSTPLT | 90 |
| VK4-01 | 11 | QQYYSTPIT | 91 |
| VK4-01 | 12 | QQYYSTPRT | 92 |
| VK4-01 | 13 | QQYYSTPWT | 93 |
| VK4-01 | 14 | QQYYSTPYT | 94 |
| VK4-01 | 15 | QQYYSTPPFT | 95 |
| VK4-01 | 16 | QQYYSTPPLT | 96 |
| VK4-01 | 17 | QQYYSTPPIT | 97 |
| VK4-01 | 18 | QQYYSTPPRT | 98 |
| VK4-01 | 19 | QQYYSTPPWT | 99 |
| VK4-01 | 20 | QQYYSTPPYT | 100 |
| VK2-28 | 1 | MQALQTPT | 101 |
| VK2-28 | 2 | MQALQTFT | 102 |
| VK2-28 | 3 | MQALQTLT | 103 |
| VK2-28 | 4 | MQALQTIT | 104 |
| VK2-28 | 5 | MQALQTRT | 105 |
| VK2-28 | 6 | MQALQTWT | 106 |
| VK2-28 | 7 | MQALQTYT | 107 |
| VK2-28 | 8 | MQALQTPPT | 108 |
| VK2-28 | 9 | MQALQTPFT | 109 |
| VK2-28 | 10 | MQALQTPLT | 110 |
| VK2-28 | 11 | MQALQTPIT | 111 |
| VK2-28 | 12 | MQALQTPRT | 112 |
| VK2-28 | 13 | MQALQTPWT | 113 |
| VK2-28 | 14 | MQALQTPYT | 114 |
| VK2-28 | 15 | MQALQTPPFT | 115 |
| VK2-28 | 16 | MQALQTPPLT | 116 |
| VK2-28 | 17 | MQALQTPPIT | 117 |
| VK2-28 | 18 | MQALQTPPRT | 118 |
| VK2-28 | 19 | MQALQTPPWT | 119 |
| VK2-28 | 20 | MQALQTPPYT | 120 |
| VK3-11 | 1 | QQRSNWPT | 121 |
| VK3-11 | 2 | QQRSNWFT | 122 |
| VK3-11 | 3 | QQRSNWLT | 123 |
| VK3-11 | 4 | QQRSNWIT | 124 |
| VK3-11 | 5 | QQRSNWRT | 125 |
| VK3-11 | 6 | QQRSNWWT | 126 |
| VK3-11 | 7 | QQRSNWYT | 127 |
| VK3-11 | 8 | QQRSNWPPT | 128 |
| VK3-11 | 9 | QQRSNWPFT | 129 |
| VK3-11 | 10 | QQRSNWPLT | 130 |
| VK3-11 | 11 | QQRSNWPIT | 131 |
| VK3-11 | 12 | QQRSNWPRT | 132 |
| VK3-11 | 13 | QQRSNWPWT | 133 |
| VK3-11 | 14 | QQRSNWPYT | 134 |
| VK3-11 | 15 | QQRSNWPPFT | 135 |
| VK3-11 | 16 | QQRSNWPPLT | 136 |

TABLE 1-continued

Germline-like sequences for eight of the VK chassis provided by the invention.

| Germline | Junction | Germline-Like CDRL3 Sequence | SEQ ID NO |
|---|---|---|---|
| VK3-11 | 17 | QQRSNWPPIT | 137 |
| VK3-11 | 18 | QQRSNWPPRT | 138 |
| VK3-11 | 19 | QQRSNWPPWT | 139 |
| VK3-11 | 20 | QQRSNWPPYT | 140 |
| VK3-15 | 1 | QQYNNWPT | 141 |
| VK3-15 | 2 | QQYNNWFT | 142 |
| VK3-15 | 3 | QQYNNWLT | 143 |
| VK3-15 | 4 | QQYNNWIT | 144 |
| VK3-15 | 5 | QQYNNWRT | 145 |
| VK3-15 | 6 | QQYNNWWT | 146 |
| VK3-15 | 7 | QQYNNWYT | 147 |
| VK3-15 | 8 | QQYNNWPPT | 148 |
| VK3-15 | 9 | QQYNNWPFT | 149 |
| VK3-15 | 10 | QQYNNWPLT | 150 |
| VK3-15 | 11 | QQYNNWPIT | 151 |
| VK3-15 | 12 | QQYNNWPRT | 152 |
| VK3-15 | 13 | QQYNNWPWT | 153 |
| VK3-15 | 14 | QQYNNWPYT | 154 |
| VK3-15 | 15 | QQYNNWPPFT | 155 |
| VK3-15 | 16 | QQYNNWPPLT | 156 |
| VK3-15 | 17 | QQYNNWPPIT | 157 |
| VK3-15 | 18 | QQYNNWPPRT | 158 |
| VK3-15 | 19 | QQYNNWPPWT | 159 |
| VK3-15 | 20 | QQYNNWPPYT | 160 |
| VK3-20 | 1 | QQYGSSPT | 161 |
| VK3-20 | 2 | QQYGSSFT | 162 |
| VK3-20 | 3 | QQYGSSLT | 163 |
| VK3-20 | 4 | QQYGSSIT | 164 |
| VK3-20 | 5 | QQYGSSRT | 165 |
| VK3-20 | 6 | QQYGSSWT | 166 |
| VK3-20 | 7 | QQYGSSYT | 167 |
| VK3-20 | 8 | QQYGSSPPT | 168 |
| VK3-20 | 9 | QQYGSSPFT | 169 |
| VK3-20 | 10 | QQYGSSPLT | 170 |
| VK3-20 | 11 | QQYGSSPIT | 171 |
| VK3-20 | 12 | QQYGSSPRT | 172 |
| VK3-20 | 13 | QQYGSSPWT | 173 |
| VK3-20 | 14 | QQYGSSPYT | 174 |
| VK3-20 | 15 | QQYGSSPPFT | 175 |
| VK3-20 | 16 | QQYGSSPPLT | 176 |
| VK3-20 | 17 | QQYGSSPPIT | 177 |
| VK3-20 | 18 | QQYGSSPPRT | 178 |
| VK3-20 | 19 | QQYGSSPPWT | 179 |
| VK3-20 | 20 | QQYGSSPPYT | 180 |

TABLE 2

Summary of framework variants for exemplified light chain germlines.

| Light Chain Germline | Number of Sequences Analyzed | Primary Framework Positions Selected for Variance | Alternative Framework Positions Selected for Variance |
|---|---|---|---|
| VK1-5 | 307 | 4, 49 | 46 |
| VK1-12 | 113 | 4, 49 | 46, 66 |
| VK1-33 | 188 | 4, 66 | 49 |
| VK1-39 | 656 | 4, 49 | 46 |
| VK2-28 | 275 | 46, 49 | 2, 4 |
| VK3-11 | 375 | 4, 36 | 2, 49 |
| VK3-15 | 202 | 4, 49 | 2, 48 |
| VK3-20 | 867 | 4, 49 | 2, 48 |
| VK4-1 | 368 | 4, 49 | 46, 66 |

TABLE 3

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK1-39 | VK1-39 | Germline | DIQMTQSPSSLSASVGDRVTITC | RASQSISSYLN | WYQQKPGKAPKLLIY | AASSLQS | GVPSRFSGSGSGTDFTLTISSLQPEDFATYYC | 181 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK1-39.1 | VK1-39 | L1 | DIQMTQSPSSLSAS VGDRVTITC | RASQSINSYLN | WYQQKPGKAPK LLIY | AASSLQS | GVPSRFSGSGS GTDFTLTISSL QPEDFATYYC | 182 |
| VK1-39.2 | VK1-39 | L1 | DIQMTQSPSSLSAS VGDRVTITC | RASQSIDSYLN | WYQQKPGKAPK LLIY | AASSLQS | GVPSRFSGSGS GTDFTLTISSL QPEDFATYYC | 183 |
| VK1-39.3 | VK1-39 | L1 | DIQMTQSPSSLSAS VGDRVTITC | RASQSISRYLN | WYQQKPGKAPK LLIY | AASSLQS | GVPSRFSGSGS GTDFTLTISSL QPEDFATYYC | 184 |
| VK1-39.6 | VK1-39 | L2 | DIQMTQSPSSLSAS VGDRVTITC | RASQSISSYLN | WYQQKPGKAPK LLIY | GASSLQS | GVPSRFSGSGS GTDFTLTISSL QPEDFATYYC | 185 |
| VK1-39.7 | VK1-39 | L2 | DIQMTQSPSSLSAS VGDRVTITC | RASQSISSYLN | WYQQKPGKAPK LLIY | SASSLQS | GVPSRFSGSGS GTDFTLTISSL QPEDFATYYC | 186 |
| VK1-39.8 | VK1-39 | L2 | DIQMTQSPSSLSAS VGDRVTITC | RASQSISSYLN | WYQQKPGKAPK LLIY | AASNLQS | GVPSRFSGSGS GTDFTLTISSL QPEDFATYYC | 187 |
| VK1-39.10 | VK1-39 | F | DIQLTQSPSSLSAS VGDRVTITC | RASQSISSYLN | WYQQKPGKAPK LLIY | AASSLQS | GVPSRFSGSGS GTDFTLTISSL QPEDFATYYC | 188 |
| VK1-39.11 | VK1-39 | FL1 | DIQLTQSPSSLSAS VGDRVTITC | RASQSINSYLN | WYQQKPGKAPK LLIY | AASSLQS | GVPSRFSGSGS GTDFTLTISSL QPEDFATYYC | 189 |
| VK1-39.12 | VK1-39 | FL1 | DIQLTQSPSSLSAS VGDRVTITC | RASQSIDSYLN | WYQQKPGKAPK LLIY | AASSLQS | GVPSRFSGSGS GTDFTLTISSL QPEDFATYYC | 190 |
| VK1-39.15 | VK1-39 | FL1 | DIQLTQSPSSLSAS VGDRVTITC | RASQSISSFLN | WYQQKPGKAPK LLIY | AASSLQS | GVPSRFSGSGS GTDFTLTISSL QPEDFATYYC | 191 |
| VK1-39.17 | VK1-39 | FL2 | DIQLTQSPSSLSAS VGDRVTITC | RASQSISSYLN | WYQQKPGKAPK LLIY | SASSLQS | GVPSRFSGSGS GTDFTLTISSL QPEDFATYYC | 192 |
| VK1-39.18 | VK1-39 | FL2 | DIQLTQSPSSLSAS VGDRVTITC | RASQSISSYLN | WYQQKPGKAPK LLIY | AASNLQS | GVPSRFSGSGS GTDFTLTISSL QPEDFATYYC | 193 |
| VK1-39.20 | VK1-39 | F | DIQMTQSPSSLSAS VGDRVTITC | RASQSISSYLN | WYQQKPGKAPK LLIS | AASSLQS | GVPSRFSGSGS GTDFTLTISSL QPEDFATYYC | 194 |
| VK1-39.23 | VK1-39 | FL1 | DIQMTQSPSSLSAS VGDRVTITC | RASQSISRYLN | WYQQKPGKAPK LLIS | AASSLQS | GVPSRFSGSGS GTDFTLTISSL QPEDFATYYC | 195 |
| VK1-39.24 | VK1-39 | FL1 | DIQMTQSPSSLSAS VGDRVTITC | RASQSISIYLN | WYQQKPGKAPK LLIS | AASSLQS | GVPSRFSGSGS GTDFTLTISSL QPEDFATYYC | 196 |
| VK1-39.25 | VK1-39 | FL1 | DIQMTQSPSSLSAS VGDRVTITC | RASQSISSFLN | WYQQKPGKAPK LLIS | AASSLQS | GVPSRFSGSGS GTDFTLTISSL QPEDFATYYC | 197 |
| VK1-05 | VK1-05 | Germline | DIQMTQSPSTLSAS VGDRVTITC | RASQSISSWLA | WYQQKPGKAPK LLIY | DASSLES | GVPSRFSGSGS GTEFTLTISSL QPDDFATYYC | 198 |
| VK1-05.1 | VK1-05 | L1 | DIQMTQSPSTLSAS VGDRVTITC | RASQGISSWLA | WYQQKPGKAPK LLIY | DASSLES | GVPSRFSGSGS GTEFTLTISSL QPDDFATYYC | 199 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK1-05.5 | VK1-05 | L2 | DIQMTQSPSTLSAS VGDRVTITC | RASQSISSWLA | WYQQKPGKAPK LLIY | EASSLES | GVPSRFSGSGS GTEFTLTISSL QPDDFATYYC | 200 |
| VK1-05.6 | VK1-05 | L2 | DIQMTQSPSTLSAS VGDRVTITC | RASQSISSWLA | WYQQKPGKAPK LLIY | KASSLES | GVPSRFSGSGS GTEFTLTISSL QPDDFATYYC | 201 |
| VK1-05.7 | VK1-05 | L12 | DIQMTQSPSTLSAS VGDRVTITC | RASQAISSWLA | WYQQKPGKAPK LLIY | KASSLES | GVPSRFSGSGS GTEFTLTISSL QPDDFATYYC | 202 |
| VK1-05.8 | VK1-05 | L12 | DIQMTQSPSTLSAS VGDRVTITC | RASQSINSWLA | WYQQKPGKAPK LLIY | KASSLES | GVPSRFSGSGS GTEFTLTISSL QPDDFATYYC | 203 |
| VK1-05.9 | VK1-05 | L12 | DIQMTQSPSTLSAS VGDRVTITC | RASQSIGSWLA | WYQQKPGKAPK LLIY | KASSLES | GVPSRFSGSGS GTEFTLTISSL QPDDFATYYC | 204 |
| VK1-05.10 | VK1-05 | F | DIQLTQSPSTLSAS VGDRVTITC | RASQSISSWLA | WYQQKPGKAPK LLIY | DASSLES | GVPSRFSGSGS GTEFTLTISSL QPDDFATYYC | 205 |
| VK1-05.11 | VK1-05 | FL1 | DIQLTQSPSTLSAS VGDRVTITC | RASQGISSWLA | WYQQKPGKAPK LLIY | DASSLES | GVPSRFSGSGS GTEFTLTISSL QPDDFATYYC | 206 |
| VK1-05.12 | VK1-05 | FL1 | DIQLTQSPSTLSAS VGDRVTITC | RASQAISSWLA | WYQQKPGKAPK LLIY | DASSLES | GVPSRFSGSGS GTEFTLTISSL QPDDFATYYC | 207 |
| VK1-05.14 | VK1-05 | FL1 | DIQLTQSPSTLSAS VGDRVTITC | RASQSIGSWLA | WYQQKPGKAPK LLIY | DASSLES | GVPSRFSGSGS GTEFTLTISSL QPDDFATYYC | 208 |
| VK1-05.20 | VK1-05 | F | DIQMTQSPSTLSAS VGDRVTITC | RASQSISSWLA | WYQQKPGKAPK LLIS | DASSLES | GVPSRFSGSGS GTEFTLTISSL QPDDFATYYC | 209 |
| VK1-05.21 | VK1-05 | FL1 | DIQMTQSPSTLSAS VGDRVTITC | RASQSINSWLA | WYQQKPGKAPK LLIS | DASSLES | GVPSRFSGSGS GTEFTLTISSL QPDDFATYYC | 210 |
| VK1-05.25 | VK1-05 | FL2 | DIQLTQSPSTLSAS VGDRVTITC | RASQSIGSWLA | WYQQKPGKAPK LLIY | KASSLES | GVPSRFSGSGS GTEFTLTISSL QPDDFATYYC | 211 |
| VK1-05.26 | VK1-05 | FL2 | DIQMTQSPSTLSAS VGDRVTITC | RASQSISSWLA | WYQQKPGKAPK LLIS | KASSLES | GVPSRFSGSGS GTEFTLTISSL QPDDFATYYC | 212 |
| VK1-12 | VK1-12 | Germline | DIQMTQSPSSVSAS VGDRVTITC | RASQGISSWLA | WYQQKPGKAPK LLIY | AASSLQS | GVPSRFSGSGS GTDFTLTISSL QPEDFATYYC | 213 |
| VK1-12.2 | VK1-12 | L1 | DIQMTQSPSSVSAS VGDRVTITC | RASQGIGSWLA | WYQQKPGKAPK LLIY | AASSLQS | GVPSRFSGSGS GTDFTLTISSL QPEDFATYYC | 214 |
| VK1-12.3 | VK1-12 | L1 | DIQMTQSPSSVSAS VGDRVTITC | RASQGIDSWLA | WYQQKPGKAPK LLIY | AASSLQS | GVPSRFSGSGS GTDFTLTISSL QPEDFATYYC | 215 |
| VK1-12.4 | VK1-12 | L1 | DIQMTQSPSSVSAS VGDRVTITC | RASQGISRWLA | WYQQKPGKAPK LLIY | AASSLQS | GVPSRFSGSGS GTDFTLTISSL QPEDFATYYC | 216 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK1-12.5 | VK1-12 | L2 | DIQMTQSPSSVSAS VGDRVTITC | RASQGISSWLA | WYQQKPGKAPK LLIY | GASSLQS | GVPSRFSGSGS GTDFTLTISSL QPEDFATYYC | 217 |
| VK1-12.6 | VK1-12 | L2 | DIQMTQSPSSVSAS VGDRVTITC | RASQGISSWLA | WYQQKPGKAPK LLIY | SASSLQS | GVPSRFSGSGS GTDFTLTISSL QPEDFATYYC | 218 |
| VK1-12.7 | VK1-12 | L2 | DIQMTQSPSSVSAS VGDRVTITC | RASQGISSWLA | WYQQKPGKAPK LLIY | AASNLQS | GVPSRFSGSGS GTDFTLTISSL QPEDFATYYC | 219 |
| VK1-12.10 | VK1-12 | F | DIQLTQSPSSVSAS VGDRVTITC | RASQGISSWLA | WYQQKPGKAPK LLIY | AASSLQS | GVPSRFSGSGS GTDFTLTISSL QPEDFATYYC | 220 |
| VK1-12.11 | VK1-12 | FL1 | DIQLTQSPSSVSAS VGDRVTITC | RASQDISSWLA | WYQQKPGKAPK LLIY | AASSLQS | GVPSRFSGSGS GTDFTLTISSL QPEDFATYYC | 221 |
| VK1-12.14 | VK1-12 | FL1 | DIQLTQSPSSVSAS VGDRVTITC | RASQGISRWLA | WYQQKPGKAPK LLIY | AASSLQS | GVPSRFSGSGS GTDFTLTISSL QPEDFATYYC | 222 |
| VK1-12.15 | VK1-12 | FL2 | DIQLTQSPSSVSAS VGDRVTITC | RASQGISSWLA | WYQQKPGKAPK LLIY | GASSLQS | GVPSRFSGSGS GTDFTLTISSL QPEDFATYYC | 223 |
| VK1-12.16 | VK1-12 | FL2 | DIQLTQSPSSVSAS VGDRVTITC | RASQGISSWLA | WYQQKPGKAPK LLIY | SASSLQS | GVPSRFSGSGS GTDFTLTISSL QPEDFATYYC | 224 |
| VK1-12.17 | VK1-12 | FL2 | DIQLTQSPSSVSAS VGDRVTITC | RASQGISSWLA | WYQQKPGKAPK LLIY | AASNLQS | GVPSRFSGSGS GTDFTLTISSL QPEDFATYYC | 225 |
| VK1-12.20 | VK1-12 | F | DIQMTQSPSSVSAS VGDRVTITC | RASQGISSWLA | WYQQKPGKAPK LLIS | AASSLQS | GVPSRFSGSGS GTDFTLTISSL QPEDFATYYC | 226 |
| VK1-12.21 | VK1-12 | FL1 | DIQMTQSPSSVSAS VGDRVTITC | RASQDISSWLA | WYQQKPGKAPK LLIS | AASSLQS | GVPSRFSGSGS GTDFTLTISSL QPEDFATYYC | 227 |
| VK1-12.23 | VK1-12 | FL1 | DIQMTQSPSSVSAS VGDRVTITC | RASQGIDSWLA | WYQQKPGKAPK LLIS | AASSLQS | GVPSRFSGSGS GTDFTLTISSL QPEDFATYYC | 228 |
| VK1-12.24 | VK1-12 | FL1 | DIQMTQSPSSVSAS VGDRVTITC | RASQGISRWLA | WYQQKPGKAPK LLIS | AASSLQS | GVPSRFSGSGS GTDFTLTISSL QPEDFATYYC | 229 |
| VK1-33 | VK1-33 | Germline | DIQMTQSPSSLSAS VGDRVTITC | QASQDISNYLN | WYQQKPGKAPK LLIY | DASNLET | GVPSRFSGSGS GTDFTFTISSL QPEDIATYYC | 230 |
| VK1-33.1 | VK1-33 | L1 | DIQMTQSPSSLSAS VGDRVTITC | QASQDITNYLN | WYQQKPGKAPK LLIY | DASNLET | GVPSRFSGSGS GTDFTFTISSL QPEDIATYYC | 231 |
| VK1-33.2 | VK1-33 | L1 | DIQMTQSPSSLSAS VGDRVTITC | QASQDIANYLN | WYQQKPGKAPK LLIY | DASNLET | GVPSRFSGSGS GTDFTFTISSL QPEDIATYYC | 232 |
| VK1-33.8 | VK1-33 | L2 | DIQMTQSPSSLSAS VGDRVTITC | QASQDISNYLN | WYQQKPGKAPK LLIY | DASNLAT | GVPSRFSGSGS GTDFTFTISSL QPEDIATYYC | 233 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK1-33.10 | VK1-33 | F | DIQLTQSPSSLSAS VGDRVTITC | QASQDISNYLN | WYQQKPGKAPK LLIY | DASNLET | GVPSRFSGSGS GTDFTFTISSL QPEDIATYYC | 234 |
| VK1-33.13 | VK1-33 | FL1 | DIQLTQSPSSLSAS VGDRVTITC | QASQDISNSLN | WYQQKPGKAPK LLIY | DASNLET | GVPSRFSGSGS GTDFTFTISSL QPEDIATYYC | 235 |
| VK1-33.14 | VK1-33 | FL1 | DIQLTQSPSSLSAS VGDRVTITC | QASQDISNFLN | WYQQKPGKAPK LLIY | DASNLET | GVPSRFSGSGS GTDFTFTISSL QPEDIATYYC | 236 |
| VK1-33.17 | VK1-33 | FL2 | DIQLTQSPSSLSAS VGDRVTITC | QASQDISNYLN | WYQQKPGKAPK LLIY | DASNLQT | GVPSRFSGSGS GTDFTFTISSL QPEDIATYYC | 237 |
| VK1-33.20 | VK1-33 | F | DIQMTQSPSSLSAS VGDRVTITC | QASQDISNYLN | WYQQKPGKAPK LLIY | DASNLET | GVPSRFSGSRS GTDFTFTISSL QPEDIATYYC | 238 |
| VK1-33.21 | VK1-33 | FL1 | DIQMTQSPSSLSAS VGDRVTITC | QASQDITNYLN | WYQQKPGKAPK LLIY | DASNLET | GVPSRFSGSRS GTDFTFTISSL QPEDIATYYC | 239 |
| VK1-33.22 | VK1-33 | FL1 | DIQMTQSPSSLSAS VGDRVTITC | QASQDIANYLN | WYQQKPGKAPK LLIY | DASNLET | GVPSRFSGSRS GTDFTFTISSL QPEDIATYYC | 240 |
| VK1-33.23 | VK1-33 | FL1 | DIQMTQSPSSLSAS VGDRVTITC | QASQDISNSLN | WYQQKPGKAPK LLIY | DASNLET | GVPSRFSGSRS GTDFTFTISSL QPEDIATYYC | 241 |
| VK1-33.24 | VK1-33 | FL1 | DIQMTQSPSSLSAS VGDRVTITC | QASQDISNFLN | WYQQKPGKAPK LLIY | DASNLET | GVPSRFSGSRS GTDFTFTISSL QPEDIATYYC | 242 |
| VK2-28 | VK2-28 | Germline | DIVMTQSPLSLPVT PGEPASISC | RSSQSLLHSN GYNYLD | WYLQKPGQSPQ LLIY | LGSNRAS | GVPDRFSGSGS GTDFTLKISRV EAEDVGVYYC | 243 |
| VK2-28.1 | VK2-28 | L1 | DIVMTQSPLSLPVT PGEPASISC | RSSQSLLYSN GYNYLD | WYLQKPGQSPQ LLIY | LGSNRAS | GVPDRFSGSGS GTDFTLKISRV EAEDVGVYYC | 244 |
| VK2-28.2 | VK2-28 | L1 | DIVMTQSPLSLPVT PGEPASISC | RSSQSLLHRN GYNYLD | WYLQKPGQSPQ LLIY | LGSNRAS | GVPDRFSGSGS GTDFTLKISRV EAEDVGVYYC | 245 |
| VK2-28.3 | VK2-28 | L1 | DIVMTQSPLSLPVT PGEPASISC | RSSQSLLHTN GYNYLD | WYLQKPGQSPQ LLIY | LGSNRAS | GVPDRFSGSGS GTDFTLKISRV EAEDVGVYYC | 246 |
| VK2-28.4 | VK2-28 | L1 | DIVMTQSPLSLPVT PGEPASISC | RSSQSLLHSN GNNYLD | WYLQKPGQSPQ LLIY | LGSNRAS | GVPDRFSGSGS GTDFTLKISRV EAEDVGVYYC | 247 |
| VK2-28.5 | VK2-28 | L2 | DIVMTQSPLSLPVT PGEPASISC | RSSQSLLHSN GYNYLD | WYLQKPGQSPQ LLIY | LASNRAS | GVPDRFSGSGS GTDFTLKISRV EAEDVGVYYC | 248 |
| VK2-28.6 | VK2-28 | L2 | DIVMTQSPLSLPVT PGEPASISC | RSSQSLLHSN GYNYLD | WYLQKPGQSPQ LLIY | LGSHRAS | GVPDRFSGSGS GTDFTLKISRV EAEDVGVYYC | 249 |
| VK2-28.10 | VK2-28 | F | DIVMTQSPLSLPVT PGEPASISC | RSSQSLLHSN GYNYLD | WYLQKPGQSPQ VLIY | LGSNRAS | GVPDRFSGSGS GTDFTLKISRV EAEDVGVYYC | 250 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK2-28.11 | VK2-28 | L1 | DIVMTQSPLSLPVT PGEPASISC | RSSQSLLYSN GYNYLD | WYLQKPGQSPQ VLIY | LGSNRAS | GVPDRFSGSGS GTDFTLKISRV EAEDVGVYYC | 251 |
| VK2-28.15 | VK2-28 | FL2 | DIVMTQSPLSLPVT PGEPASISC | RSSQSLLHSN GYNYLD | WYLQKPGQSPQ VLIY | LASNRAS | GVPDRFSGSGS GTDFTLKISRV EAEDVGVYYC | 252 |
| VK2-28.17 | VK2-28 | FL2 | DIVMTQSPLSLPVT PGEPASISC | RSSQSLLHSN GYNYLD | WYLQKPGQSPQ VLIY | LGSSRAS | GVPDRFSGSGS GTDFTLKISRV EAEDVGVYYC | 253 |
| VK2-28.20 | VK2-28 | F | DIVMTQSPLSLPVT PGEPASISC | RSSQSLLHSN GYNYLD | WYLQKPGQSPQ LLIF | LGSNRAS | GVPDRFSGSGS GTDFTLKISRV EAEDVGVYYC | 254 |
| VK2-28.24 | VK2-28 | FL1 | DIVMTQSPLSLPVT PGEPASISC | RSSQSLLHSN GNNYLD | WYLQKPGQSPQ LLIF | LGSNRAS | GVPDRFSGSGS GTDFTLKISRV EAEDVGVYYC | 255 |
| VK3-11 | VK3-11 | Germline | EIVLTQSPATLSLS PGERATLSC | RASQSVSSYLA | WYQQKPGQAPR LLIY | DASNRAT | GIPARFSGSGS GTDFTLTISSL EPEDFAVYYC | 256 |
| VK3-11.2 | VK3-11 | L1 | EIVLTQSPATLSLS PGERATLSC | RASQSVSRYLA | WYQQKPGQAPR LLIY | DASNRAT | GIPARFSGSGS GTDFTLTISSL EPEDFAVYYC | 257 |
| VK3-11.3 | VK3-11 | L1 | EIVLTQSPATLSLS PGERATLSC | RASQSVSNYLA | WYQQKPGQAPR LLIY | DASNRAT | GIPARFSGSGS GTDFTLTISSL EPEDFAVYYC | 258 |
| VK3-11.4 | VK3-11 | L2 | EIVLTQSPATLSLS PGERATLSC | RASQSVSSYLA | WYQQKPGQAPR LLIY | DSSNRAT | GIPARFSGSGS GTDFTLTISSL EPEDFAVYYC | 259 |
| VK3-11.5 | VK3-11 | L2 | EIVLTQSPATLSLS PGERATLSC | RASQSVSSYLA | WYQQKPGQAPR LLIY | DTSNRAT | GIPARFSGSGS GTDFTLTISSL EPEDFAVYYC | 260 |
| VK3-11.6 | VK3-11 | L2 | EIVLTQSPATLSLS PGERATLSC | RASQSVSSYLA | WYQQKPGQAPR LLIY | DASKRAT | GIPARFSGSGS GTDFTLTISSL EPEDFAVYYC | 261 |
| VK3-11.10 | VK3-11 | F | EIVMTQSPATLSLS PGERATLSC | RASQSVSSYLA | WYQQKPGQAPR LLIY | DASNRAT | GIPARFSGSGS GTDFTLTISSL EPEDFAVYYC | 262 |
| VK3-11.13 | VK3-11 | FL1 | EIVMTQSPATLSLS PGERATLSC | RASQSVSNYLA | WYQQKPGQAPR LLIY | DASNRAT | GIPARFSGSGS GTDFTLTISSL EPEDFAVYYC | 263 |
| VK3-11.14 | VK3-11 | FL2 | EIVMTQSPATLSLS PGERATLSC | RASQSVSSYLA | WYQQKPGQAPR LLIY | DSSNRAT | GIPARFSGSGS GTDFTLTISSL EPEDFAVYYC | 264 |
| VK3-11.15 | VK3-11 | FL2 | EIVMTQSPATLSLS PGERATLSC | RASQSVSSYLA | WYQQKPGQAPR LLIY | DTSNRAT | GIPARFSGSGS GTDFTLTISSL EPEDFAVYYC | 265 |
| VK3-11.16 | VK3-11 | FL2 | EIVMTQSPATLSLS PGERATLSC | RASQSVSSYLA | WYQQKPGQAPR LLIY | DASKRAT | GIPARFSGSGS GTDFTLTISSL EPEDFAVYYC | 266 |
| VK3-11.20 | VK3-11 | F | EIVLTQSPATLSLS PGERATLSC | RASQSVSSYLA | WFQQKPGQAPR LLIY | DASNRAT | GIPARFSGSGS GTDFTLTISSL EPEDFAVYYC | 267 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK3-11.21 | VK3-11 | FL1 | EIVLTQSPATLSLSPGERATLSC | RASQSISSYLA | WFQQKPGQAPRLLIY | DASNRAT | GIPARFSGSGSGTDFTLTISSLEPEDFAVYYC | 268 |
| VK3-11.24 | VK3-11 | FL2 | EIVLTQSPATLSLSPGERATLSC | RASQSVSSYLA | WFQQKPGQAPRLLIY | DSSNRAT | GIPARFSGSGSGTDFTLTISSLEPEDFAVYYC | 269 |
| VK3-11.25 | VK3-11 | FL2 | EIVLTQSPATLSLSPGERATLSC | RASQSVSSYLA | WFQQKPGQAPRLLIY | DTSNRAT | GIPARFSGSGSGTDFTLTISSLEPEDFAVYYC | 270 |
| VK3-15 | VK3-15 | Germline | EIVMTQSPATLSVSPGERATLSC | RASQSVSSNLA | WYQQKPGQAPRLLIY | GASTRAT | GIPARFSGSGSGTEFTLTISSLQSEDFAVYYC | 271 |
| VK3-15.1 | VK3-15 | L1 | EIVMTQSPATLSVSPGERATLSC | RASQSVGSNLA | WYQQKPGQAPRLLIY | GASTRAT | GIPARFSGSGSGTEFTLTISSLQSEDFAVYYC | 272 |
| VK3-15.6 | VK3-15 | L1 | EIVMTQSPATLSVSPGERATLSC | RASQSVSSSLA | WYQQKPGQAPRLLIY | GASTRAT | GIPARFSGSGSGTEFTLTISSLQSEDFAVYYC | 273 |
| VK3-15.7 | VK3-15 | L2 | EIVMTQSPATLSVSPGERATLSC | RASQSVSSNLA | WYQQKPGQAPRLLIY | DASTRAT | GIPARFSGSGSGTEFTLTISSLQSEDFAVYYC | 274 |
| VK3-15.8 | VK3-15 | L2 | EIVMTQSPATLSVSPGERATLSC | RASQSVSSNLA | WYQQKPGQAPRLLIY | SASTRAT | GIPARFSGSGSGTEFTLTISSLQSEDFAVYYC | 275 |
| VK3-15.10 | VK3-15 | F | EIVLTQSPATLSVSPGERATLSC | RASQSVSSNLA | WYQQKPGQAPRLLIY | GASTRAT | GIPARFSGSGSGTEFTLTISSLQSEDFAVYYC | 276 |
| VK3-15.11 | VK3-15 | FL1 | EIVLTQSPATLSVSPGERATLSC | RASQSVGSNLA | WYQQKPGQAPRLLIY | GASTRAT | GIPARFSGSGSGTEFTLTISSLQSEDFAVYYC | 277 |
| VK3-15.14 | VK3-15 | FL1 | EIVLTQSPATLSVSPGERATLSC | RASQSVSTNLA | WYQQKPGQAPRLLIY | GASTRAT | GIPARFSGSGSGTEFTLTISSLQSEDFAVYYC | 278 |
| VK3-15.16 | VK3-15 | FL1 | EIVLTQSPATLSVSPGERATLSC | RASQSVSSDLA | WYQQKPGQAPRLLIY | GASTRAT | GIPARFSGSGSGTEFTLTISSLQSEDFAVYYC | 279 |
| VK3-15.20 | VK3-15 | F | EIVMTQSPATLSVSPGERATLSC | RASQSVSSNLA | WYQQKPGQAPRLLIF | GASTRAT | GIPARFSGSGSGTEFTLTISSLQSEDFAVYYC | 280 |
| VK3-15.21 | VK3-15 | FL1 | EIVMTQSPATLSVSPGERATLSC | RASQSVGSNLA | WYQQKPGQAPRLLIF | GASTRAT | GIPARFSGSGSGTEFTLTISSLQSEDFAVYYC | 281 |
| VK3-15.25 | VK3-15 | FL1 | EIVMTQSPATLSVSPGERATLSC | RASQSVSSDLA | WYQQKPGQAPRLLIF | GASTRAT | GIPARFSGSGSGTEFTLTISSLQSEDFAVYYC | 282 |
| VK3-15.26 | VK3-15 | FL1 | EIVMTQSPATLSVSPGERATLSC | RASQSVSSSL | WYQQKPGQAPRLLIF | GASTRAT | GIPARFSGSGSGTEFTLTISSLQSEDFAVYYC | 283 |
| VK3-20 | VK3-20 | Germline | EIVLTQSPGTLSLSPGERATLSC | RASQSVSSSYLA | WYQQKPGQAPRLLIY | GASSRAT | GIPDRFSGSGSGTDFTLTISRLEPEDFAVYYC | 284 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK3-20.1 | VK3-20 | L1 | EIVLTQSPGTLSLSPGERATLSC | RASQSVRSSYLA | WYQQKPGQAPRLLIY | GASSRAT | GIPDRFSGSGSGTDFTLTISRLEPEDFAVYYC | 285 |
| VK3-20.4 | VK3-20 | L1 | EIVLTQSPGTLSLSPGERATLSC | RASQSVSSDYLA | WYQQKPGQAPRLLIY | GASSRAT | GIPDRFSGSGSGTDFTLTISRLEPEDFAVYYC | 286 |
| VK3-20.7 | VK3-20 | L2 | EIVLTQSPGTLSLSPGERATLSC | RASQSVSSSYLA | WYQQKPGQAPRLLIY | GASNRAT | GIPDRFSGSGSGTDFTLTISRLEPEDFAVYYC | 287 |
| VK3-20.8 | VK3-20 | L2 | EIVLTQSPGTLSLSPGERATLSC | RASQSVSSSYLA | WYQQKPGQAPRLLIY | GASRRAT | GIPDRFSGSGSGTDFTLTISRLEPEDFAVYYC | 288 |
| VK3-20.10 | VK3-20 | F | EIVMTQSPGTLSLSPGERATLSC | RASQSVSSSYLA | WYQQKPGQAPRLLIY | GASSRAT | GIPDRFSGSGSGTDFTLTISRLEPEDFAVYYC | 289 |
| VK3-20.17 | VK3-20 | FL2 | EIVMTQSPGTLSLSPGERATLSC | RASQSVSSSYLA | WYQQKPGQAPRLLIY | GASNRAT | GIPDRFSGSGSGTDFTLTISRLEPEDFAVYYC | 290 |
| VK3-20.20 | VK3-20 | F | EIVLTQSPGTLSLSPGERATLSC | RASQSVSSSYLA | WYQQKPGQAPRLLIS | GASSRAT | GIPDRFSGSGSGTDFTLTISRLEPEDFAVYYC | 291 |
| VK3-20.22 | VK3-20 | FL1 | EIVLTQSPGTLSLSPGERATLSC | RASQSVSSNYLA | WYQQKPGQAPRLLIS | GASSRAT | GIPDRFSGSGSGTDFTLTISRLEPEDFAVYYC | 292 |
| VK4-01 | VK4-01 | Germline | DIVMTQSPDSLAVSLGERATINC | KSSQSVLYSSNNKNYLA | WYQQKPGQPPKLLIY | WASTRES | GVPDRFSGSGSGTDFTLTISSLQAEDVAVYYC | 293 |
| VK4-01.1 | VK4-01 | L1 | DIVMTQSPDSLAVSLGERATINC | KSSQSLLYSSNNKNYLA | WYQQKPGQPPKLLIY | WASTRES | GVPDRFSGSGSGTDFTLTISSLQAEDVAVYYC | 294 |
| VK4-01.2 | VK4-01 | L1 | DIVMTQSPDSLAVSLGERATINC | KSSQSILYSSNNKNYLA | WYQQKPGQPPKLLIY | WASTRES | GVPDRFSGSGSGTDFTLTISSLQAEDVAVYYC | 295 |
| VK4-01.3 | VK4-01 | L1 | DIVMTQSPDSLAVSLGERATINC | KSSQSVLHSSNNKNYLA | WYQQKPGQPPKLLIY | WASTRES | GVPDRFSGSGSGTDFTLTISSLQAEDVAVYYC | 296 |
| VK4-01.4 | VK4-01 | L1 | DIVMTQSPDSLAVSLGERATINC | KSSQSVLFSSNNKNYLA | WYQQKPGQPPKLLIY | WASTRES | GVPDRFSGSGSGTDFTLTISSLQAEDVAVYYC | 297 |
| VK4-01.5 | VK4-01 | L1 | DIVMTQSPDSLAVSLGERATINC | KSSQSVLYTSNNKNYLA | WYQQKPGQPPKLLIY | WASTRES | GVPDRFSGSGSGTDFTLTISSLQAEDVAVYYC | 298 |
| VK4-01.7 | VK4-01 | L2 | DIVMTQSPDSLAVSLGERATINC | KSSQSVLYSSNNKNYLA | WYQQKPGQPPKLLIY | WASSRES | GVPDRFSGSGSGTDFTLTISSLQAEDVAVYYC | 299 |
| VK4-01.10 | VK4-01 | F | DIVLTQSPDSLAVSLGERATINC | KSSQSVLYSSNNKNYLA | WYQQKPGQPPKLLIY | WASTRES | GVPDRFSGSGSGTDFTLTISSLQAEDVAVYYC | 300 |
| VK4-01.13 | VK4-01 | FL1 | DIVLTQSPDSLAVSLGERATINC | KSSQSVLHSSNNKNYLA | WYQQKPGQPPKLLIY | WASTRES | GVPDRFSGSGSGTDFTLTISSLQAEDVAVYYC | 301 |

TABLE 3-continued

Polypeptide sequences of exemplified light chain chassis with variability in CDRL1, CDRL2, and frameworks. The Kabat numbers for segment boundaries are indicated. Here, L1 and L2 (in the "Category" column) indicate variability in CDRL1 and CDRL2, respectively, while "F" indicates a framework variant. Sequences designated with both L1 or L2 and F contain variability in both a CDR and framework region.

| Name | Chassis | Category | FRM1: 1-23 | CDR1: 24-34 | FRM2: 35-49 | CDR2: 50-56 | FRM3: 57-88 | SEQ ID NOs: |
|---|---|---|---|---|---|---|---|---|
| VK4-01.17 | VK4-01 | FL2 | DIVLTQSPDSLAVSLGERATINC | KSSQSVLYSSNNKNYLA | WYQQKPGQPPKLLIY | WASSRES | GVPDRFSGSGSGTDFTLTISSLQAEDVAVYYC | 302 |
| VK4-01.20 | VK4-01 | F | DIVMTQSPDSLAVSLGERATINC | KSSQSVLYSSNNKNYLA | WYQQKPGQPPKLLIS | WASTRES | GVPDRFSGSGSGTDFTLTISSLQAEDVAVYYC | 303 |
| VK4-01.23 | VK4-01 | FL1 | DIVMTQSPDSLAVSLGERATINC | KSSQSVLHSSNNKNYLA | WYQQKPGQPPKLLIS | WASTRES | GVPDRFSGSGSGTDFTLTISSLQAEDVAVYYC | 304 |

TABLE 4

Jumping dimer and trimer oligonucleotides for the VK1-39 sequences with CDRL3 length nine and F as the junctional amino acid. i.e., The sequences depicted below occur between YYC and FGG, to yield: ...YYC-[89-97]-FGG... .
The sequences in this table encompassed by positions "[89-97]" are disclosed as

| Name | Oligo | SEQ ID NO | 89 | 90 | 91 | 92 | 93 | 94 | 95 | 96 | 97 |
|---|---|---|---|---|---|---|---|---|---|---|---|
| | | | | | Jumping Dimer | | | | | | |
| VK1-39_1 | SWMSWMAGCTACAGTACTCCTTWCACT | 305 | DEHLQV | DEHLQV | S | Y | S | T | P | FY | T |
| VK1-39_2 | SWMCAAVNABHCAGTACTCCTTWCACT | 306 | DEHLQV | Q | AEGIKLPQRTV | Y | S | T | P | FY | T |
| VK1-39_3 | SWMCAAAGCBHCAGTACTCCTTWCACT | 307 | DEHLQV | Q | S | ADFHLPSVY | S | T | P | FY | T |
| VK1-39_4 | SWMCAAAGCTACNHCACTCCTTWCACT | 308 | DEHLQV | Q | S | Y | ADFHILNPSTVY | T | P | FY | T |
| VK1-39_5 | SWMCAAAGCTACAGTBHCCCTTWCACT | 309 | DEHLQV | Q | S | Y | S | ADFHLPSVY | P | FY | T |
| VK1-39_6 | CAGSWMVNATACAGTACTCCTTWCACT | 310 | Q | DEHLQV | AEGIKLPQRTV | Y | S | T | P | FY | T |
| VK1-39_7 | CAGSWMAGCBHCAGTACTCCTTWCACT | 311 | Q | DEHLQV | S | ADFHLPSVY | S | T | P | FY | T |
| VK1-39_8 | CAGSWMAGCTACNHCACTCCTTWCACT | 312 | Q | DEHLQV | S | Y | ADFHILNPSTVY | T | P | FY | T |
| VK1-39_9 | CAGSWMAGCTACAGTBHCCCTTWCACT | 313 | Q | DEHLQV | S | Y | S | ADFHLPSVY | P | FY | T |
| VK1-39_10 | CAGCAAVNABHCAGTACTCCTTWCACT | 314 | Q | Q | AEGIKLPQRTV | ADFHLPSVY | S | T | P | FY | T |

TABLE 4-continued

Jumping dimer and trimer oligonucleotides for the VK1-39 sequences with CDRL3 length nine and F as the junctional amino acid. i.e., The sequences depicted below occur between YYC and FGG, to yield:
...YYC-[89-97]-FGG... .
The sequences in this table encompassed by positions "[89-97]" are disclosed as

| Name | Oligo | SEQ ID NO | 89 | 90 | 91 | 92 | 93 | 94 | 95 | 96 | 97 |
|---|---|---|---|---|---|---|---|---|---|---|---|
| VK1-39_11 | CAGCAAVNATACNHCACTCCTTWCACT | 315 | Q | Q | AEGIKLPQRTV | Y | ADFHILNPSTVY | T | P | FY | T |
| VK1-39_12 | CAGCAAVNATACAGTBHCCCTTWCACT | 316 | Q | Q | AEGIKLPQRTV | Y | S | ADFHLPSVY | P | FY | T |
| VK1-39_13 | CAGCAAAGCBHCNHCACTCCTTWCACT | 317 | Q | Q | S | ADFHLPSVY | ADFHILNPSTVY | T | P | FY | T |
| VK1-39_14 | CAGCAAAGCBHCAGTBHCCCTTWCACT | 318 | Q | Q | S | ADFHLPSVY | S | ADFHLPSVY | P | FY | T |
| VK1-39_15 | CAGCAAAGCTACNHCBHCCCTTWCACT | 319 | Q | Q | S | Y | ADFHILNPSTVY | ADFHLPSVY | P | FY | T |
| Jumping Trimer | | | | | | | | | | | |
| VK1-39_10_0_9 | CAGCAAVNABHCAGTACTCCTTWCACT | 314 | Q | Q | AEGIKLPQRTV | ADFHLPSVY | S | T | P | FY | T |
| VK1-39_11_0_9 | CAGCAAVNATACNHCACTCCTTWCACT | 315 | Q | Q | AEGIKLPQRTV | Y | ADFHILNPSTVY | T | P | FY | T |
| VK1-39_12_0_9 | CAGCAAVNATACAGTBHCCCTTWCACT | 316 | Q | Q | AEGIKLPQRTV | Y | S | ADFHLPSVY | P | FY | T |
| VK1-39_13_0_9 | CAGCAAAGCBHCNHCACTCCTTWCACT | 317 | Q | Q | S | ADFHLPSVY | ADFHILNPSTVY | T | P | FY | T |
| VK1-39_14_0_9 | CAGCAAAGCBHCAGTBHCCCTTWCACT | 318 | Q | Q | S | ADFHLPSVY | S | ADFHLPSVY | P | FY | T |
| VK1-39_15_0_9 | CAGCAAAGCTACNHCBHCCCTTWCACT | 319 | Q | Q | S | Y | ADFHILNPSTVY | ADFHLPSVY | P | FY | T |
| VK1-39_t1_0_9 | CAGCAAVNABHCNHCACTCCTTWCACT | 320 | Q | Q | AEGIKLPQRTV | ADFHLPSVY | ADFHILNPSTVY | T | P | FY | T |
| VK1-39_t2_0_9 | CAGCAAVNABHCAGTBHCCCTTWCACT | 321 | Q | Q | AEGIKLPQRTV | ADFHLPSVY | S | ADFHLPSVY | P | FY | T |
| VK1-39_t3_0_9 | CAGCAAVNATACNHCBHCCCTTWCACT | 322 | Q | Q | AEGIKLPQRTV | Y | ADFHILNPSTVY | ADFHLPSVY | P | FY | T |
| VK1-39_t4_0_9 | CAGCAAAGCBHCNHCBHCCCTTWCACT | 323 | Q | Q | S | ADFHLPSVY | ADFHILNPSTVY | ADFHLPSVY | P | FY | T |

TABLE 5

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| Jumping Dimer | | | | |
| VK1-05_1_0_8 | CCTGATGATTTTGCAACTTATTACTGCSWMSWMTACAATAGTTACTWCACTTTTGGCGGAGGGACCAAG | SWMSWMTACAATAGTTACTWCACT | 324 | 948 |
| VK1-05_10_0_8 | CCTGATGATTTTGCAACTTATTACTGCCAGCAGBHCVRMAGTTACTWCACTTTTGGCGGAGGGACCAAG | CAGCAGBHCVRMAGTTACTWCACT | 325 | 949 |
| VK1-05_11_0_8 | CCTGATGATTTTGCAACTTATTACTGCCAGCAGBHCAATMBCTACTWCACTTTTGGCGGAGGGACCAAG | CAGCAGBHCAATMBCTACTWCACT | 326 | 950 |
| VK1-05_12_0_8 | CCTGATGATTTTGCAACTTATTACTGCCAGCAGBHCAATAGTYWCTWCACTTTTGGCGGAGGGACCAAG | CAGCAGBHCAATAGTYWCTWCACT | 327 | 951 |
| VK1-05_13_0_8 | CCTGATGATTTTGCAACTTATTACTGCCAGCAGTACVRMMBCTACTWCACTTTTGGCGGAGGGACCAAG | CAGCAGTACVRMMBCTACTWCACT | 328 | 952 |
| VK1-05_14_0_8 | CCTGATGATTTTGCAACTTATTACTGCCAGCAGTACVRMAGTYWCTWCACTTTTGGCGGAGGGACCAAG | CAGCAGTACVRMAGTYWCTWCACT | 329 | 953 |
| VK1-05_15_0_8 | CCTGATGATTTTGCAACTTATTACTGCCAGCAGTACAATMBCYWCTWCACTTTTGGCGGAGGGACCAAG | CAGCAGTACAATMBCYWCTWCACT | 330 | 954 |
| VK1-05_2_0_8 | CCTGATGATTTTGCAACTTATTACTGCSWMCAGBHCAATAGTTACTWCACTTTTGGCGGAGGGACCAAG | SWMCAGBHCAATAGTTACTWCACT | 331 | 955 |
| VK1-05_3_0_8 | CCTGATGATTTTGCAACTTATTACTGCSWMCAGTACVRMAGTTACTWCACTTTTGGCGGAGGGACCAAG | SWMCAGTACVRMAGTTACTWCACT | 332 | 956 |
| VK1-05_4_0_8 | CCTGATGATTTTGCAACTTATTACTGCSWMCAGTACAATMBCTACTWCACTTTTGGCGGAGGGACCAAG | SWMCAGTACAATMBCTACTWCACT | 333 | 957 |
| VK1-05_5_0_8 | CCTGATGATTTTGCAACTTATTACTGCSWMCAGTACAATAGTYWCTWCACTTTTGGCGGAGGGACCAAG | SWMCAGTACAATAGTYWCTWCACT | 334 | 958 |
| VK1-05_6_0_8 | CCTGATGATTTTGCAACTTATTACTGCCAGSWMBHCAATAGTTACTWCACTTTTGGCGGAGGGACCAAG | CAGSWMBHCAATAGTTACTWCACT | 335 | 959 |
| VK1-05_7_0_8 | CCTGATGATTTTGCAACTTATTACTGCCAGSWMTACVRMAGTTACTWCACTTTTGGCGGAGGGACCAAG | CAGSWMTACVRMAGTTACTWCACT | 336 | 960 |
| VK1-05_8_0_8 | CCTGATGATTTTGCAACTTATTACTGCCAGSWMTACAATMBCTACTWCACTTTTGGCGGAGGGACCAAG | CAGSWMTACAATMBCTACTWCACT | 337 | 961 |
| VK1-05_9_0_8 | CCTGATGATTTTGCAACTTATTACTGCCAGSWMTACAATAGTYWCTWCACTTTTGGCGGAGGGACCAAG | CAGSWMTACAATAGTYWCTWCACT | 338 | 962 |
| VK1-05_1_1_8 | CCTGATGATTTTGCAACTTATTACTGCSWMSWMTACAATAGTTACMTCACTTTTGGCGGAGGGACCAAG | SWMSWMTACAATAGTTACMTCACT | 339 | 963 |
| VK1-05_10_1_8 | CCTGATGATTTTGCAACTTATTACTGCCAGCAGBHCVRMAGTTACMTCACTTTTGGCGGAGGGACCAAG | CAGCAGBHCVRMAGTTACMTCACT | 340 | 964 |
| VK1-05_11_1_8 | CCTGATGATTTTGCAACTTATTACTGCCAGCAGBHCAATMBCTACMTCACTTTTGGCGGAGGGACCAAG | CAGCAGBHCAATMBCTACMTCACT | 341 | 965 |
| VK1-05_12_1_8 | CCTGATGATTTTGCAACTTATTACTGCCAGCAGBHCAATAGTYWCMTCACTTTTGGCGGAGGGACCAAG | CAGCAGBHCAATAGTYWCMTCACT | 342 | 966 |
| VK1-05_13_1_8 | CCTGATGATTTTGCAACTTATTACTGCCAGCAGTACVRMMBCTACMTCACTTTTGGCGGAGGGACCAAG | CAGCAGTACVRMMBCTACMTCACT | 343 | 967 |
| VK1-05_14_1_8 | CCTGATGATTTTGCAACTTATTACTGCCAGCAGTACVRMAGTYWCMTCACTTTTGGCGGAGGGACCAAG | CAGCAGTACVRMAGTYWCMTCACT | 344 | 968 |
| VK1-05_15_1_8 | CCTGATGATTTTGCAACTTATTACTGCCAGCAGTACAATMBCYWCMTCACTTTTGGCGGAGGGACCAAG | CAGCAGTACAATMBCYWCMTCACT | 345 | 969 |
| VK1-05_2_1_8 | CCTGATGATTTTGCAACTTATTACTGCSWMCAGBHCAATAGTTACMTCACTTTTGGCGGAGGGACCAAG | SWMCAGBHCAATAGTTACMTCACT | 346 | 970 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-05_3_1_8 | CCTGATGATTTTGCAACTTATTACTGCSWMCAGTACVRMAGTTACMTCACTTTTGGCGGAGGGACCAAG | SWMCAGTACVRMAGTTACMTCACT | 347 | 971 |
| VK1-05_4_1_8 | CCTGATGATTTTGCAACTTATTACTGCSWMCAGTACAATMBCTACMTCACTTTTGGCGGAGGGACCAAG | SWMCAGTACAATMBCTACMTCACT | 348 | 972 |
| VK1-05_5_1_8 | CCTGATGATTTTGCAACTTATTACTGCSWMCAGTACAATAGTYWCMTCACTTTTGGCGGAGGGACCAAG | SWMCAGTACAATAGTYWCMTCACT | 349 | 973 |
| VK1-05_6_1_8 | CCTGATGATTTTGCAACTTATTACTGCCAGSWMBHCAATAGTTACMTCACTTTTGGCGGAGGGACCAAG | CAGSWMBHCAATAGTTACMTCACT | 350 | 974 |
| VK1-05_7_1_8 | CCTGATGATTTTGCAACTTATTACTGCCAGSWMTACVRMAGTTACMTCACTTTTGGCGGAGGGACCAAG | CAGSWMTACVRMAGTTACMTCACT | 351 | 975 |
| VK1-05_8_1_8 | CCTGATGATTTTGCAACTTATTACTGCCAGSWMTACAATMBCTACMTCACTTTTGGCGGAGGGACCAAG | CAGSWMTACAATMBCTACMTCACT | 352 | 976 |
| VK1-05_9_1_8 | CCTGATGATTTTGCAACTTATTACTGCCAGSWMTACAATAGTYWCMTCACTTTTGGCGGAGGGACCAAG | CAGSWMTACAATAGTYWCMTCACT | 353 | 977 |
| VK1-05_1_2_8 | CCTGATGATTTTGCAACTTATTACTGCSWMSWMTACAATAGTTACWGGACTTTTGGCGGAGGGACCAAG | SWMSWMTACAATAGTTACWGGACT | 354 | 978 |
| VK1-05_10_2_8 | CCTGATGATTTTGCAACTTATTACTGCCAGCAGBHCVRMAGTTACWGGACTTTTGGCGGAGGGACCAAG | CAGCAGBHCVRMAGTTACWGGACT | 355 | 979 |
| VK1-05_11_2_8 | CCTGATGATTTTGCAACTTATTACTGCCAGCAGBHCAATMBCTACWGGACTTTTGGCGGAGGGACCAAG | CAGCAGBHCAATMBCTACWGGACT | 356 | 980 |
| VK1-05_12_2_8 | CCTGATGATTTTGCAACTTATTACTGCCAGCAGBHCAATAGTYWCWGGACTTTTGGCGGAGGGACCAAG | CAGCAGBHCAATAGTYWCWGGACT | 357 | 981 |
| VK1-05_13_2_8 | CCTGATGATTTTGCAACTTATTACTGCCAGCAGTACVRMMBCTACWGGACTTTTGGCGGAGGGACCAAG | CAGCAGTACVRMMBCTACWGGACT | 358 | 982 |
| VK1-05_14_2_8 | CCTGATGATTTTGCAACTTATTACTGCCAGCAGTACVRMAGTYWCWGGACTTTTGGCGGAGGGACCAAG | CAGCAGTACVRMAGTYWCWGGACT | 359 | 983 |
| VK1-05_15_2_8 | CCTGATGATTTTGCAACTTATTACTGCCAGCAGTACAATMBCYWCWGGACTTTTGGCGGAGGGACCAAG | CAGCAGTACAATMBCYWCWGGACT | 360 | 984 |
| VK1-05_2_2_8 | CCTGATGATTTTGCAACTTATTACTGCSWMCAGBHCAATAGTTACWGGACTTTTGGCGGAGGGACCAAG | SWMCAGBHCAATAGTTACWGGACT | 361 | 985 |
| VK1-05_3_2_8 | CCTGATGATTTTGCAACTTATTACTGCSWMCAGTACVRMAGTTACWGGACTTTTGGCGGAGGGACCAAG | SWMCAGTACVRMAGTTACWGGACT | 362 | 986 |
| VK1-05_4_2_8 | CCTGATGATTTTGCAACTTATTACTGCSWMCAGTACAATMBCTACWGGACTTTTGGCGGAGGGACCAAG | SWMCAGTACAATMBCTACWGGACT | 363 | 987 |
| VK1-05_5_2_8 | CCTGATGATTTTGCAACTTATTACTGCSWMCAGTACAATAGTYWCWGGACTTTTGGCGGAGGGACCAAG | SWMCAGTACAATAGTYWCWGGACT | 364 | 988 |
| VK1-05_6_2_8 | CCTGATGATTTTGCAACTTATTACTGCCAGSWMBHCAATAGTTACWGGACTTTTGGCGGAGGGACCAAG | CAGSWMBHCAATAGTTACWGGACT | 365 | 989 |
| VK1-05_7_2_8 | CCTGATGATTTTGCAACTTATTACTGCCAGSWMTACVRMAGTTACWGGACTTTTGGCGGAGGGACCAAG | CAGSWMTACVRMAGTTACWGGACT | 366 | 990 |
| VK1-05_8_2_8 | CCTGATGATTTTGCAACTTATTACTGCCAGSWMTACAATMBCTACWGGACTTTTGGCGGAGGGACCAAG | CAGSWMTACAATMBCTACWGGACT | 367 | 991 |
| VK1-05_9_2_8 | CCTGATGATTTTGCAACTTATTACTGCCAGSWMTACAATAGTYWCWGGACTTTTGGCGGAGGGACCAAG | CAGSWMTACAATAGTYWCWGGACT | 368 | 992 |
| VK1-05_1_3_8 | CCTGATGATTTTGCAACTTATTACTGCSWMSWMTACAATAGTTACCCTACTTTTGGCGGAGGGACCAAG | SWMSWMTACAATAGTTACCCTACT | 369 | 993 |
| VK1-05_10_3_8 | CCTGATGATTTTGCAACTTATTACTGCCAGCAGBHCVRMAGTTACCCTACTTTTGGCGGAGGGACCAAG | CAGCAGBHCVRMAGTTACCCTACT | 370 | 994 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-05_11_3_8 | CCTGATGATTTTGCAACTTATTACTGCCAGCAGBHCAATMBCTACCCTACTTTTGGCGGAGGGACCAAG | CAGCAGBHCAATMBCTACCCTACT | 371 | 995 |
| VK1-05_12_3_8 | CCTGATGATTTTGCAACTTATTACTGCCAGCAGBHCAATAGTYWCCCTACTTTTGGCGGAGGGACCAAG | CAGCAGBHCAATAGTYWCCCTACT | 372 | 996 |
| VK1-05_13_3_8 | CCTGATGATTTTGCAACTTATTACTGCCAGCAGTACVRMMBCTACCCTACTTTTGGCGGAGGGACCAAG | CAGCAGTACVRMMBCTACCCTACT | 373 | 997 |
| VK1-05_14_3_8 | CCTGATGATTTTGCAACTTATTACTGCCAGCAGTACVRMAGTYWCCCTACTTTTGGCGGAGGGACCAAG | CAGCAGTACVRMAGTYWCCCTACT | 374 | 998 |
| VK1-05_15_3_8 | CCTGATGATTTTGCAACTTATTACTGCCAGCAGTACAATMBCYWCCCTACTTTTGGCGGAGGGACCAAG | CAGCAGTACAATMBCYWCCCTACT | 375 | 999 |
| VK1-05_2_3_8 | CCTGATGATTTTGCAACTTATTACTGCSWMCAGBHCAATAGTTACCCTACTTTTGGCGGAGGGACCAAG | SWMCAGBHCAATAGTTACCCTACT | 376 | 1000 |
| VK1-05_3_3_8 | CCTGATGATTTTGCAACTTATTACTGCSWMCAGTACVRMAGTTACCCTACTTTTGGCGGAGGGACCAAG | SWMCAGTACVRMAGTTACCCTACT | 377 | 1001 |
| VK1-05_4_3_8 | CCTGATGATTTTGCAACTTATTACTGCSWMCAGTACAATMBCTACCCTACTTTTGGCGGAGGGACCAAG | SWMCAGTACAATMBCTACCCTACT | 378 | 1002 |
| VK1-05_5_3_8 | CCTGATGATTTTGCAACTTATTACTGCSWMCAGTACAATAGTYWCCCTACTTTTGGCGGAGGGACCAAG | SWMCAGTACAATAGTYWCCCTACT | 379 | 1003 |
| VK1-05_6_3_8 | CCTGATGATTTTGCAACTTATTACTGCCAGSWMBHCAATAGTTACCCTACTTTTGGCGGAGGGACCAAG | CAGSWMBHCAATAGTTACCCTACT | 380 | 1004 |
| VK1-05_7_3_8 | CCTGATGATTTTGCAACTTATTACTGCCAGSWMTACVRMAGTTACCCTACTTTTGGCGGAGGGACCAAG | CAGSWMTACVRMAGTTACCCTACT | 381 | 1005 |
| VK1-05_8_3_8 | CCTGATGATTTTGCAACTTATTACTGCCAGSWMTACAATMBCTACCCTACTTTTGGCGGAGGGACCAAG | CAGSWMTACAATMBCTACCCTACT | 382 | 1006 |
| VK1-05_9_3_8 | CCTGATGATTTTGCAACTTATTACTGCCAGSWMTACAATAGTYWCCCTACTTTTGGCGGAGGGACCAAG | CAGSWMTACAATAGTYWCCCTACT | 383 | 1007 |
| VK1-12_1_0_8 | CCTGAAGATTTTGCAACTTATTACTGTSWMSWMGCAAATAGTTTCTWCACTTTTGGCGGAGGGACCAAG | SWMSWMGCAAATAGTTTCTWCACT | 384 | 1008 |
| VK1-12_10_0_8 | CCTGAAGATTTTGCAACTTATTACTGTCAGCAGRNANHCAGTTTCTWCACTTTTGGCGGAGGGACCAAG | CAGCAGRNANHCAGTTTCTWCACT | 385 | 1009 |
| VK1-12_11_0_8 | CCTGAAGATTTTGCAACTTATTACTGTCAGCAGRNAAATNHCTTCTWCACTTTTGGCGGAGGGACCAAG | CAGCAGRNAAATNHCTTCTWCACT | 386 | 1010 |
| VK1-12_12_0_8 | CCTGAAGATTTTGCAACTTATTACTGTCAGCAGRNAAATAGTYWCTWCACTTTTGGCGGAGGGACCAAG | CAGCAGRNAAATAGTYWCTWCACT | 387 | 1011 |
| VK1-12_13_0_8 | CCTGAAGATTTTGCAACTTATTACTGTCAGCAGGCANHCNHCTTCTWCACTTTTGGCGGAGGGACCAAG | CAGCAGGCANHCNHCTTCTWCACT | 388 | 1012 |
| VK1-12_14_0_8 | CCTGAAGATTTTGCAACTTATTACTGTCAGCAGGCANHCAGTYWCTWCACTTTTGGCGGAGGGACCAAG | CAGCAGGCANHCAGTYWCTWCACT | 389 | 1013 |
| VK1-12_15_0_8 | CCTGAAGATTTTGCAACTTATTACTGTCAGCAGGCAAATNHCYWCTWCACTTTTGGCGGAGGGACCAAG | CAGCAGGCAAATNHCYWCTWCACT | 390 | 1014 |
| VK1-12_2_0_8 | CCTGAAGATTTTGCAACTTATTACTGTSWMCAGRNAAATAGTTTCTWCACTTTTGGCGGAGGGACCAAG | SWMCAGRNAAATAGTTTCTWCACT | 391 | 1015 |
| VK1-12_3_0_8 | CCTGAAGATTTTGCAACTTATTACTGTSWMCAGGCANHCAGTTTCTWCACTTTTGGCGGAGGGACCAAG | SWMCAGGCANHCAGTTTCTWCACT | 392 | 1016 |
| VK1-12_4_0_8 | CCTGAAGATTTTGCAACTTATTACTGTSWMCAGGCAAATNHCTTCTWCACTTTTGGCGGAGGGACCAAG | SWMCAGGCAAATNHCTTCTWCACT | 393 | 1017 |
| VK1-12_5_0_8 | CCTGAAGATTTTGCAACTTATTACTGTSWMCAGGCAAATAGTYWCTWCACTTTTGGCGGAGGGACCAAG | SWMCAGGCAAATAGTYWCTWCACT | 394 | 1018 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_6_0_8 | CCTGAAGATTTTGCAACTTATTACTGTCAGSWMRNAAATAGTTTCTWCACTTTTGGCGGAGGGACCAAG | CAGSWMRNAAATAGTTTCTWCACT | 395 | 1019 |
| VK1-12_7_0_8 | CCTGAAGATTTTGCAACTTATTACTGTCAGSWMGCANHCAGTTTCTWCACTTTTGGCGGAGGGACCAAG | CAGSWMGCANHCAGTTTCTWCACT | 396 | 1020 |
| VK1-12_8_0_8 | CCTGAAGATTTTGCAACTTATTACTGTCAGSWMGCAAATNHCTTCTWCACTTTTGGCGGAGGGACCAAG | CAGSWMGCAAATNHCTTCTWCACT | 397 | 1021 |
| VK1-12_9_0_8 | CCTGAAGATTTTGCAACTTATTACTGTCAGSWMGCAAATAGTYWCTWCACTTTTGGCGGAGGGACCAAG | CAGSWMGCAAATAGTYWCTWCACT | 398 | 1022 |
| VK1-12_1_1_8 | CCTGAAGATTTTGCAACTTATTACTGTSWMSWMGCAAATAGTTTCMTCACTTTTGGCGGAGGGACCAAG | SWMSWMGCAAATAGTTTCMTCACT | 399 | 1023 |
| VK1-12_10_1_8 | CCTGAAGATTTTGCAACTTATTACTGTCAGCAGRNANHCAGTTTCMTCACTTTTGGCGGAGGGACCAAG | CAGCAGRNANHCAGTTTCMTCACT | 400 | 1024 |
| VK1-12_11_1_8 | CCTGAAGATTTTGCAACTTATTACTGTCAGCAGRNAAATNHCTTCMTCACTTTTGGCGGAGGGACCAAG | CAGCAGRNAAATNHCTTCMTCACT | 401 | 1025 |
| VK1-12_12_1_8 | CCTGAAGATTTTGCAACTTATTACTGTCAGCAGRNAAATAGTYWCMTCACTTTTGGCGGAGGGACCAAG | CAGCAGRNAAATAGTYWCMTCACT | 402 | 1026 |
| VK1-12_13_1_8 | CCTGAAGATTTTGCAACTTATTACTGTCAGCAGGCANHCNHCTTCMTCACTTTTGGCGGAGGGACCAAG | CAGCAGGCANHCNHCTTCMTCACT | 403 | 1027 |
| VK1-12_14_1_8 | CCTGAAGATTTTGCAACTTATTACTGTCAGCAGGCANHCAGTYWCMTCACTTTTGGCGGAGGGACCAAG | CAGCAGGCANHCAGTYWCMTCACT | 404 | 1028 |
| VK1-12_15_1_8 | CCTGAAGATTTTGCAACTTATTACTGTCAGCAGGCAAATNHCYWCMTCACTTTTGGCGGAGGGACCAAG | CAGCAGGCAAATNHCYWCMTCACT | 405 | 1029 |
| VK1-12_2_1_8 | CCTGAAGATTTTGCAACTTATTACTGTSWMCAGRNAAATAGTTTCMTCACTTTTGGCGGAGGGACCAAG | SWMCAGRNAAATAGTTTCMTCACT | 406 | 1030 |
| VK1-12_3_1_8 | CCTGAAGATTTTGCAACTTATTACTGTSWMCAGGCANHCAGTTTCMTCACTTTTGGCGGAGGGACCAAG | SWMCAGGCANHCAGTTTCMTCACT | 407 | 1031 |
| VK1-12_4_1_8 | CCTGAAGATTTTGCAACTTATTACTGTSWMCAGGCAAATNHCTTCMTCACTTTTGGCGGAGGGACCAAG | SWMCAGGCAAATNHCTTCMTCACT | 408 | 1032 |
| VK1-12_5_1_8 | CCTGAAGATTTTGCAACTTATTACTGTSWMCAGGCAAATAGTYWCMTCACTTTTGGCGGAGGGACCAAG | SWMCAGGCAAATAGTYWCMTCACT | 409 | 1033 |
| VK1-12_6_1_8 | CCTGAAGATTTTGCAACTTATTACTGTCAGSWMRNAAATAGTTTCMTCACTTTTGGCGGAGGGACCAAG | CAGSWMRNAAATAGTTTCMTCACT | 410 | 1034 |
| VK1-12_7_1_8 | CCTGAAGATTTTGCAACTTATTACTGTCAGSWMGCANHCAGTTTCMTCACTTTTGGCGGAGGGACCAAG | CAGSWMGCANHCAGTTTCMTCACT | 411 | 1035 |
| VK1-12_8_1_8 | CCTGAAGATTTTGCAACTTATTACTGTCAGSWMGCAAATNHCTTCMTCACTTTTGGCGGAGGGACCAAG | CAGSWMGCAAATNHCTTCMTCACT | 412 | 1036 |
| VK1-12_9_1_8 | CCTGAAGATTTTGCAACTTATTACTGTCAGSWMGCAAATAGTYWCMTCACTTTTGGCGGAGGGACCAAG | CAGSWMGCAAATAGTYWCMTCACT | 413 | 1037 |
| VK1-12_1_2_8 | CCTGAAGATTTTGCAACTTATTACTGTSWMSWMGCAAATAGTTTCWGGACTTTTGGCGGAGGGACCAAG | SWMSWMGCAAATAGTTTCWGGACT | 414 | 1038 |
| VK1-12_10_2_8 | CCTGAAGATTTTGCAACTTATTACTGTCAGCAGRNANHCAGTTTCWGGACTTTTGGCGGAGGGACCAAG | CAGCAGRNANHCAGTTTCWGGACT | 415 | 1039 |
| VK1-12_11_2_8 | CCTGAAGATTTTGCAACTTATTACTGTCAGCAGRNAAATNHCTTCWGGACTTTTGGCGGAGGGACCAAG | CAGCAGRNAAATNHCTTCWGGACT | 416 | 1040 |
| VK1-12_12_2_8 | CCTGAAGATTTTGCAACTTATTACTGTCAGCAGRNAAATAGTYWCWGGACTTTTGGCGGAGGGACCAAG | CAGCAGRNAAATAGTYWCWGGACT | 417 | 1041 |
| VK1-12_13_2_8 | CCTGAAGATTTTGCAACTTATTACTGTCAGCAGGCANHCNHCTTCWGGACTTTTGGCGGAGGGACCAAG | CAGCAGGCANHCNHCTTCWGGACT | 418 | 1042 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_14_2_8 | CCTGAAGATTTTGCAACTTATTACTGTCAGCAGGCANHCAGTYWCWGGACTTTTGGCGGAGGGACCAAG | CAGCAGGCANHCAGTYWCWGGACT | 419 | 1043 |
| VK1-12_15_2_8 | CCTGAAGATTTTGCAACTTATTACTGTCAGCAGGCAAATNHCYWCWGGACTTTTGGCGGAGGGACCAAG | CAGCAGGCAAATNHCYWCWGGACT | 420 | 1044 |
| VK1-12_2_2_8 | CCTGAAGATTTTGCAACTTATTACTGTSWMCAGRNAAATAGTTTCWGGACTTTTGGCGGAGGGACCAAG | SWMCAGRNAAATAGTTTCWGGACT | 421 | 1045 |
| VK1-12_3_2_8 | CCTGAAGATTTTGCAACTTATTACTGTSWMCAGGCANHCAGTTTCWGGACTTTTGGCGGAGGGACCAAG | SWMCAGGCANHCAGTTTCWGGACT | 422 | 1046 |
| VK1-12_4_2_8 | CCTGAAGATTTTGCAACTTATTACTGTSWMCAGGCAAATNHCTTCWGGACTTTTGGCGGAGGGACCAAG | SWMCAGGCAAATNHCTTCWGGACT | 423 | 1047 |
| VK1-12_5_2_8 | CCTGAAGATTTTGCAACTTATTACTGTSWMCAGGCAAATAGTYWCWGGACTTTTGGCGGAGGGACCAAG | SWMCAGGCAAATAGTYWCWGGACT | 424 | 1048 |
| VK1-12_6_2_8 | CCTGAAGATTTTGCAACTTATTACTGTCAGSWMRNAAATAGTTTCWGGACTTTTGGCGGAGGGACCAAG | CAGSWMRNAAATAGTTTCWGGACT | 425 | 1049 |
| VK1-12_7_2_8 | CCTGAAGATTTTGCAACTTATTACTGTCAGSWMGCANHCAGTTTCWGGACTTTTGGCGGAGGGACCAAG | CAGSWMGCANHCAGTTTCWGGACT | 426 | 1050 |
| VK1-12_8_2_8 | CCTGAAGATTTTGCAACTTATTACTGTCAGSWMGCAAATNHCTTCWGGACTTTTGGCGGAGGGACCAAG | CAGSWMGCAAATNHCTTCWGGACT | 427 | 1051 |
| VK1-12_9_2_8 | CCTGAAGATTTTGCAACTTATTACTGTCAGSWMGCAAATAGTYWCWGGACTTTTGGCGGAGGGACCAAG | CAGSWMGCAAATAGTYWCWGGACT | 428 | 1052 |
| VK1-12_1_3_8 | CCTGAAGATTTTGCAACTTATTACTGTSWMSWMGCAAATAGTTTCCCTACTTTTGGCGGAGGGACCAAG | SWMSWMGCAAATAGTTTCCCTACT | 429 | 1053 |
| VK1-12_10_3_8 | CCTGAAGATTTTGCAACTTATTACTGTCAGCAGRNANHCAGTTTCCCTACTTTTGGCGGAGGGACCAAG | CAGCAGRNANHCAGTTTCCCTACT | 430 | 1054 |
| VK1-12_11_3_8 | CCTGAAGATTTTGCAACTTATTACTGTCAGCAGRNAAATNHCTTCCCTACTTTTGGCGGAGGGACCAAG | CAGCAGRNAAATNHCTTCCCTACT | 431 | 1055 |
| VK1-12_12_3_8 | CCTGAAGATTTTGCAACTTATTACTGTCAGCAGRNAAATAGTYWCCCTACTTTTGGCGGAGGGACCAAG | CAGCAGRNAAATAGTYWCCCTACT | 432 | 1056 |
| VK1-12_13_3_8 | CCTGAAGATTTTGCAACTTATTACTGTCAGCAGGCANHCNHCTTCCCTACTTTTGGCGGAGGGACCAAG | CAGCAGGCANHCNHCTTCCCTACT | 433 | 1057 |
| VK1-12_14_3_8 | CCTGAAGATTTTGCAACTTATTACTGTCAGCAGGCANHCAGTYWCCCTACTTTTGGCGGAGGGACCAAG | CAGCAGGCANHCAGTYWCCCTACT | 434 | 1058 |
| VK1-12_15_3_8 | CCTGAAGATTTTGCAACTTATTACTGTCAGCAGGCAAATNHCYWCCCTACTTTTGGCGGAGGGACCAAG | CAGCAGGCAAATNHCYWCCCTACT | 435 | 1059 |
| VK1-12_2_3_8 | CCTGAAGATTTTGCAACTTATTACTGTSWMCAGRNAAATAGTTTCCCTACTTTTGGCGGAGGGACCAAG | SWMCAGRNAAATAGTTTCCCTACT | 436 | 1060 |
| VK1-12_3_3_8 | CCTGAAGATTTTGCAACTTATTACTGTSWMCAGGCANHCAGTTTCCCTACTTTTGGCGGAGGGACCAAG | SWMCAGGCANHCAGTTTCCCTACT | 437 | 1061 |
| VK1-12_4_3_8 | CCTGAAGATTTTGCAACTTATTACTGTSWMCAGGCAAATNHCTTCCCTACTTTTGGCGGAGGGACCAAG | SWMCAGGCAAATNHCTTCCCTACT | 438 | 1062 |
| VK1-12_5_3_8 | CCTGAAGATTTTGCAACTTATTACTGTSWMCAGGCAAATAGTYWCCCTACTTTTGGCGGAGGGACCAAG | SWMCAGGCAAATAGTYWCCCTACT | 439 | 1063 |
| VK1-12_6_3_8 | CCTGAAGATTTTGCAACTTATTACTGTCAGSWMRNAAATAGTTTCCCTACTTTTGGCGGAGGGACCAAG | CAGSWMRNAAATAGTTTCCCTACT | 440 | 1064 |
| VK1-12_7_3_8 | CCTGAAGATTTTGCAACTTATTACTGTCAGSWMGCANHCAGTTTCCCTACTTTTGGCGGAGGGACCAAG | CAGSWMGCANHCAGTTTCCCTACT | 441 | 1065 |
| VK1-12_8_3_8 | CCTGAAGATTTTGCAACTTATTACTGTCAGSWMGCAAATNHCTTCCCTACTTTTGGCGGAGGGACCAAG | CAGSWMGCAAATNHCTTCCCTACT | 442 | 1066 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_9_3_8 | CCTGAAGATTTTGCAACTTATTACTGTCAGSWMGCAAATAGTYWCCCTACTTTTGGCGGAGGGACCAAG | CAGSWMGCAAATAGTYWCCCTACT | 443 | 1067 |
| VK1-33_1_0_8 | CCTGAAGATATTGCAACATATTACTGTSWMSWMTACGATAATCTCTWCACTTTTGGCGGAGGGACCAAG | SWMSWMTACGATAATCTCTWCACT | 444 | 1068 |
| VK1-33_10_0_8 | CCTGAAGATATTGCAACATATTACTGTCAGCAGBHCNHCAATCTCTWCACTTTTGGCGGAGGGACCAAG | CAGCAGBHCNHCAATCTCTWCACT | 445 | 1069 |
| VK1-33_11_0_8 | CCTGAAGATATTGCAACATATTACTGTCAGCAGBHCGATNHCCTCTWCACTTTTGGCGGAGGGACCAAG | CAGCAGBHCGATNHCCTCTWCACT | 446 | 1070 |
| VK1-33_12_0_8 | CCTGAAGATATTGCAACATATTACTGTCAGCAGBHCGATAATYWCTWCACTTTTGGCGGAGGGACCAAG | CAGCAGBHCGATAATYWCTWCACT | 447 | 1071 |
| VK1-33_13_0_8 | CCTGAAGATATTGCAACATATTACTGTCAGCAGTACNHCNHCCTCTWCACTTTTGGCGGAGGGACCAAG | CAGCAGTACNHCNHCCTCTWCACT | 448 | 1072 |
| VK1-33_14_0_8 | CCTGAAGATATTGCAACATATTACTGTCAGCAGTACNHCAATYWCTWCACTTTTGGCGGAGGGACCAAG | CAGCAGTACNHCAATYWCTWCACT | 449 | 1073 |
| VK1-33_15_0_8 | CCTGAAGATATTGCAACATATTACTGTCAGCAGTACGATNHCYWCTWCACTTTTGGCGGAGGGACCAAG | CAGCAGTACGATNHCYWCTWCACT | 450 | 1074 |
| VK1-33_2_0_8 | CCTGAAGATATTGCAACATATTACTGTSWMCAGBHCGATAATCTCTWCACTTTTGGCGGAGGGACCAAG | SWMCAGBHCGATAATCTCTWCACT | 451 | 1075 |
| VK1-33_3_0_8 | CCTGAAGATATTGCAACATATTACTGTSWMCAGTACNHCAATCTCTWCACTTTTGGCGGAGGGACCAAG | SWMCAGTACNHCAATCTCTWCACT | 452 | 1076 |
| VK1-33_4_0_8 | CCTGAAGATATTGCAACATATTACTGTSWMCAGTACGATNHCCTCTWCACTTTTGGCGGAGGGACCAAG | SWMCAGTACGATNHCCTCTWCACT | 453 | 1077 |
| VK1-33_5_0_8 | CCTGAAGATATTGCAACATATTACTGTSWMCAGTACGATAATYWCTWCACTTTTGGCGGAGGGACCAAG | SWMCAGTACGATAATYWCTWCACT | 454 | 1078 |
| VK1-33_6_0_8 | CCTGAAGATATTGCAACATATTACTGTCAGSWMBHCGATAATCTCTWCACTTTTGGCGGAGGGACCAAG | CAGSWMBHCGATAATCTCTWCACT | 455 | 1079 |
| VK1-33_7_0_8 | CCTGAAGATATTGCAACATATTACTGTCAGSWMTACNHCAATCTCTWCACTTTTGGCGGAGGGACCAAG | CAGSWMTACNHCAATCTCTWCACT | 456 | 1080 |
| VK1-33_8_0_8 | CCTGAAGATATTGCAACATATTACTGTCAGSWMTACGATNHCCTCTWCACTTTTGGCGGAGGGACCAAG | CAGSWMTACGATNHCCTCTWCACT | 457 | 1081 |
| VK1-33_9_0_8 | CCTGAAGATATTGCAACATATTACTGTCAGSWMTACGATAATYWCTWCACTTTTGGCGGAGGGACCAAG | CAGSWMTACGATAATYWCTWCACT | 458 | 1082 |
| VK1-33_1_1_8 | CCTGAAGATATTGCAACATATTACTGTSWMSWMTACGATAATCTCMTCACTTTTGGCGGAGGGACCAAG | SWMSWMTACGATAATCTCMTCACT | 459 | 1083 |
| VK1-33_10_1_8 | CCTGAAGATATTGCAACATATTACTGTCAGCAGBHCNHCAATCTCMTCACTTTTGGCGGAGGGACCAAG | CAGCAGBHCNHCAATCTCMTCACT | 460 | 1084 |
| VK1-33_11_1_8 | CCTGAAGATATTGCAACATATTACTGTCAGCAGBHCGATNHCCTCMTCACTTTTGGCGGAGGGACCAAG | CAGCAGBHCGATNHCCTCMTCACT | 461 | 1085 |
| VK1-33_12_1_8 | CCTGAAGATATTGCAACATATTACTGTCAGCAGBHCGATAATYWCMTCACTTTTGGCGGAGGGACCAAG | CAGCAGBHCGATAATYWCMTCACT | 462 | 1086 |
| VK1-33_13_1_8 | CCTGAAGATATTGCAACATATTACTGTCAGCAGTACNHCNHCCTCMTCACTTTTGGCGGAGGGACCAAG | CAGCAGTACNHCNHCCTCMTCACT | 463 | 1087 |
| VK1-33_14_1_8 | CCTGAAGATATTGCAACATATTACTGTCAGCAGTACNHCAATYWCMTCACTTTTGGCGGAGGGACCAAG | CAGCAGTACNHCAATYWCMTCACT | 464 | 1088 |
| VK1-33_15_1_8 | CCTGAAGATATTGCAACATATTACTGTCAGCAGTACGATNHCYWCMTCACTTTTGGCGGAGGGACCAAG | CAGCAGTACGATNHCYWCMTCACT | 465 | 1089 |
| VK1-33_2_1_8 | CCTGAAGATATTGCAACATATTACTGTSWMCAGBHCGATAATCTCMTCACTTTTGGCGGAGGGACCAAG | SWMCAGBHCGATAATCTCMTCACT | 466 | 1090 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_3_1_8 | CCTGAAGATATTGCAACATATTACTGTSWMCAGTACNHCAATCTCMTCACTTTTGGCGGAGGGACCAAG | SWMCAGTACNHCAATCTCMTCACT | 467 | 1091 |
| VK1-33_4_1_8 | CCTGAAGATATTGCAACATATTACTGTSWMCAGTACGATNHCCTCMTCACTTTTGGCGGAGGGACCAAG | SWMCAGTACGATNHCCTCMTCACT | 468 | 1092 |
| VK1-33_5_1_8 | CCTGAAGATATTGCAACATATTACTGTSWMCAGTACGATAATYWCMTCACTTTTGGCGGAGGGACCAAG | SWMCAGTACGATAATYWCMTCACT | 469 | 1093 |
| VK1-33_6_1_8 | CCTGAAGATATTGCAACATATTACTGTCAGSWMBHCGATAATCTCMTCACTTTTGGCGGAGGGACCAAG | CAGSWMBHCGATAATCTCMTCACT | 470 | 1094 |
| VK1-33_7_1_8 | CCTGAAGATATTGCAACATATTACTGTCAGSWMTACNHCAATCTCMTCACTTTTGGCGGAGGGACCAAG | CAGSWMTACNHCAATCTCMTCACT | 471 | 1095 |
| VK1-33_8_1_8 | CCTGAAGATATTGCAACATATTACTGTCAGSWMTACGATNHCCTCMTCACTTTTGGCGGAGGGACCAAG | CAGSWMTACGATNHCCTCMTCACT | 472 | 1096 |
| VK1-33_9_1_8 | CCTGAAGATATTGCAACATATTACTGTCAGSWMTACGATAATYWCMTCACTTTTGGCGGAGGGACCAAG | CAGSWMTACGATAATYWCMTCACT | 473 | 1097 |
| VK1-33_1_2_8 | CCTGAAGATATTGCAACATATTACTGTSWMSWMTACGATAATCTCWGGACTTTTGGCGGAGGGACCAAG | SWMSWMTACGATAATCTCWGGACT | 474 | 1098 |
| VK1-33_10_2_8 | CCTGAAGATATTGCAACATATTACTGTCAGCAGBHCNHCAATCTCWGGACTTTTGGCGGAGGGACCAAG | CAGCAGBHCNHCAATCTCWGGACT | 475 | 1099 |
| VK1-33_11_2_8 | CCTGAAGATATTGCAACATATTACTGTCAGCAGBHCGATNHCCTCWGGACTTTTGGCGGAGGGACCAAG | CAGCAGBHCGATNHCCTCWGGACT | 476 | 1100 |
| VK1-33_12_2_8 | CCTGAAGATATTGCAACATATTACTGTCAGCAGBHCGATAATYWCWGGACTTTTGGCGGAGGGACCAAG | CAGCAGBHCGATAATYWCWGGACT | 477 | 1101 |
| VK1-33_13_2_8 | CCTGAAGATATTGCAACATATTACTGTCAGCAGTACNHCNHCCTCWGGACTTTTGGCGGAGGGACCAAG | CAGCAGTACNHCNHCCTCWGGACT | 478 | 1102 |
| VK1-33_14_2_8 | CCTGAAGATATTGCAACATATTACTGTCAGCAGTACNHCAATYWCWGGACTTTTGGCGGAGGGACCAAG | CAGCAGTACNHCAATYWCWGGACT | 479 | 1103 |
| VK1-33_15_2_8 | CCTGAAGATATTGCAACATATTACTGTCAGCAGTACGATNHCYWCWGGACTTTTGGCGGAGGGACCAAG | CAGCAGTACGATNHCYWCWGGACT | 480 | 1104 |
| VK1-33_2_2_8 | CCTGAAGATATTGCAACATATTACTGTSWMCAGBHCGATAATCTCWGGACTTTTGGCGGAGGGACCAAG | SWMCAGBHCGATAATCTCWGGACT | 481 | 1105 |
| VK1-33_3_2_8 | CCTGAAGATATTGCAACATATTACTGTSWMCAGTACNHCAATCTCWGGACTTTTGGCGGAGGGACCAAG | SWMCAGTACNHCAATCTCWGGACT | 482 | 1106 |
| VK1-33_4_2_8 | CCTGAAGATATTGCAACATATTACTGTSWMCAGTACGATNHCCTCWGGACTTTTGGCGGAGGGACCAAG | SWMCAGTACGATNHCCTCWGGACT | 483 | 1107 |
| VK1-33_5_2_8 | CCTGAAGATATTGCAACATATTACTGTSWMCAGTACGATAATYWCWGGACTTTTGGCGGAGGGACCAAG | SWMCAGTACGATAATYWCWGGACT | 484 | 1108 |
| VK1-33_6_2_8 | CCTGAAGATATTGCAACATATTACTGTCAGSWMBHCGATAATCTCWGGACTTTTGGCGGAGGGACCAAG | CAGSWMBHCGATAATCTCWGGACT | 485 | 1109 |
| VK1-33_7_2_8 | CCTGAAGATATTGCAACATATTACTGTCAGSWMTACNHCAATCTCWGGACTTTTGGCGGAGGGACCAAG | CAGSWMTACNHCAATCTCWGGACT | 486 | 1110 |
| VK1-33_8_2_8 | CCTGAAGATATTGCAACATATTACTGTCAGSWMTACGATNHCCTCWGGACTTTTGGCGGAGGGACCAAG | CAGSWMTACGATNHCCTCWGGACT | 487 | 1111 |
| VK1-33_9_2_8 | CCTGAAGATATTGCAACATATTACTGTCAGSWMTACGATAATYWCWGGACTTTTGGCGGAGGGACCAAG | CAGSWMTACGATAATYWCWGGACT | 488 | 1112 |
| VK1-33_1_3_8 | CCTGAAGATATTGCAACATATTACTGTSWMSWMTACGATAATCTCCCTACTTTTGGCGGAGGGACCAAG | SWMSWMTACGATAATCTCCCTACT | 489 | 1113 |
| VK1-33_10_3_8 | CCTGAAGATATTGCAACATATTACTGTCAGCAGBHCNHCAATCTCCCTACTTTTGGCGGAGGGACCAAG | CAGCAGBHCNHCAATCTCCCTACT | 490 | 1114 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_11_3_8 | CCTGAAGATATTGCAACATATTACTGTCAGCAGBHCGATNHCCTCCCTACTTTTGGCGGAGGGACCAAG | CAGCAGBHCGATNHCCTCCCTACT | 491 | 1115 |
| VK1-33_12_3_8 | CCTGAAGATATTGCAACATATTACTGTCAGCAGBHCGATAATYWCCCTACTTTTGGCGGAGGGACCAAG | CAGCAGBHCGATAATYWCCCTACT | 492 | 1116 |
| VK1-33_13_3_8 | CCTGAAGATATTGCAACATATTACTGTCAGCAGTACNHCNHCCTCCCTACTTTTGGCGGAGGGACCAAG | CAGCAGTACNHCNHCCTCCCTACT | 493 | 1117 |
| VK1-33_14_3_8 | CCTGAAGATATTGCAACATATTACTGTCAGCAGTACNHCAATYWCCCTACTTTTGGCGGAGGGACCAAG | CAGCAGTACNHCAATYWCCCTACT | 494 | 1118 |
| VK1-33_15_3_8 | CCTGAAGATATTGCAACATATTACTGTCAGCAGTACGATNHCYWCCCTACTTTTGGCGGAGGGACCAAG | CAGCAGTACGATNHCYWCCCTACT | 495 | 1119 |
| VK1-33_2_3_8 | CCTGAAGATATTGCAACATATTACTGTSWMCAGBHCGATAATCTCCCTACTTTTGGCGGAGGGACCAAG | SWMCAGBHCGATAATCTCCCTACT | 496 | 1120 |
| VK1-33_3_3_8 | CCTGAAGATATTGCAACATATTACTGTSWMCAGTACNHCAATCTCCCTACTTTTGGCGGAGGGACCAAG | SWMCAGTACNHCAATCTCCCTACT | 497 | 1121 |
| VK1-33_4_3_8 | CCTGAAGATATTGCAACATATTACTGTSWMCAGTACGATNHCCTCCCTACTTTTGGCGGAGGGACCAAG | SWMCAGTACGATNHCCTCCCTACT | 498 | 1122 |
| VK1-33_5_3_8 | CCTGAAGATATTGCAACATATTACTGTSWMCAGTACGATAATYWCCCTACTTTTGGCGGAGGGACCAAG | SWMCAGTACGATAATYWCCCTACT | 499 | 1123 |
| VK1-33_6_3_8 | CCTGAAGATATTGCAACATATTACTGTCAGSWMBHCGATAATCTCCCTACTTTTGGCGGAGGGACCAAG | CAGSWMBHCGATAATCTCCCTACT | 500 | 1124 |
| VK1-33_7_3_8 | CCTGAAGATATTGCAACATATTACTGTCAGSWMTACNHCAATCTCCCTACTTTTGGCGGAGGGACCAAG | CAGSWMTACNHCAATCTCCCTACT | 501 | 1125 |
| VK1-33_8_3_8 | CCTGAAGATATTGCAACATATTACTGTCAGSWMTACGATNHCCTCCCTACTTTTGGCGGAGGGACCAAG | CAGSWMTACGATNHCCTCCCTACT | 502 | 1126 |
| VK1-33_9_3_8 | CCTGAAGATATTGCAACATATTACTGTCAGSWMTACGATAATYWCCCTACTTTTGGCGGAGGGACCAAG | CAGSWMTACGATAATYWCCCTACT | 503 | 1127 |
| VK1-39_1_0_8 | CCTGAAGATTTTGCAACTTACTACTGTSWMSWMAGCTACAGTACTTWCACTTTTGGCGGAGGGACCAAG | SWMSWMAGCTACAGTACTTWCACT | 504 | 1128 |
| VK1-39_10_0_8 | CCTGAAGATTTTGCAACTTACTACTGTCAGCAAVNABHCAGTACTTWCACTTTTGGCGGAGGGACCAAG | CAGCAAVNABHCAGTACTTWCACT | 505 | 1129 |
| VK1-39_11_0_8 | CCTGAAGATTTTGCAACTTACTACTGTCAGCAAVNATACNHCACTTWCACTTTTGGCGGAGGGACCAAG | CAGCAAVNATACNHCACTTWCACT | 506 | 1130 |
| VK1-39_12_0_8 | CCTGAAGATTTTGCAACTTACTACTGTCAGCAAVNATACAGTBHCTWCACTTTTGGCGGAGGGACCAAG | CAGCAAVNATACAGTBHCTWCACT | 507 | 1131 |
| VK1-39_13_0_8 | CCTGAAGATTTTGCAACTTACTACTGTCAGCAAAGCBHCNHCACTTWCACTTTTGGCGGAGGGACCAAG | CAGCAAAGCBHCNHCACTTWCACT | 508 | 1132 |
| VK1-39_14_0_8 | CCTGAAGATTTTGCAACTTACTACTGTCAGCAAAGCBHCAGTBHCTWCACTTTTGGCGGAGGGACCAAG | CAGCAAAGCBHCAGTBHCTWCACT | 509 | 1133 |
| VK1-39_15_0_8 | CCTGAAGATTTTGCAACTTACTACTGTCAGCAAAGCTACNHCBHCTWCACTTTTGGCGGAGGGACCAAG | CAGCAAAGCTACNHCBHCTWCACT | 510 | 1134 |
| VK1-39_2_0_8 | CCTGAAGATTTTGCAACTTACTACTGTSWMCAAVNATACAGTACTTWCACTTTTGGCGGAGGGACCAAG | SWMCAAVNATACAGTACTTWCACT | 511 | 1135 |
| VK1-39_3_0_8 | CCTGAAGATTTTGCAACTTACTACTGTSWMCAAAGCBHCAGTACTTWCACTTTTGGCGGAGGGACCAAG | SWMCAAAGCBHCAGTACTTWCACT | 512 | 1136 |
| VK1-39_4_0_8 | CCTGAAGATTTTGCAACTTACTACTGTSWMCAAAGCTACNHCACTTWCACTTTTGGCGGAGGGACCAAG | SWMCAAAGCTACNHCACTTWCACT | 513 | 1137 |
| VK1-39_5_0_8 | CCTGAAGATTTTGCAACTTACTACTGTSWMCAAAGCTACAGTBHCTWCACTTTTGGCGGAGGGACCAAG | SWMCAAAGCTACAGTBHCTWCACT | 514 | 1138 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_6_0_8 | CCTGAAGATTTTGCAACTTACTACTGTCAGSWMVNATACAGTACTTWCACTTTTGGCGGAGGGACCAAG | CAGSWMVNATACAGTACTTWCACT | 515 | 1139 |
| VK1-39_7_0_8 | CCTGAAGATTTTGCAACTTACTACTGTCAGSWMAGCBHCAGTACTTWCACTTTTGGCGGAGGGACCAAG | CAGSWMAGCBHCAGTACTTWCACT | 516 | 1140 |
| VK1-39_8_0_8 | CCTGAAGATTTTGCAACTTACTACTGTCAGSWMAGCTACNHCACTTWCACTTTTGGCGGAGGGACCAAG | CAGSWMAGCTACNHCACTTWCACT | 517 | 1141 |
| VK1-39_9_0_8 | CCTGAAGATTTTGCAACTTACTACTGTCAGSWMAGCTACAGTBHCTWCACTTTTGGCGGAGGGACCAAG | CAGSWMAGCTACAGTBHCTWCACT | 518 | 1142 |
| VK1-39_1_1_8 | CCTGAAGATTTTGCAACTTACTACTGTSWMSWMAGCTACAGTACTMTCACTTTTGGCGGAGGGACCAAG | SWMSWMAGCTACAGTACTMTCACT | 519 | 1143 |
| VK1-39_10_1_8 | CCTGAAGATTTTGCAACTTACTACTGTCAGCAAVNABHCAGTACTMTCACTTTTGGCGGAGGGACCAAG | CAGCAAVNABHCAGTACTMTCACT | 520 | 1144 |
| VK1-39_11_1_8 | CCTGAAGATTTTGCAACTTACTACTGTCAGCAAVNATACNHCACTMTCACTTTTGGCGGAGGGACCAAG | CAGCAAVNATACNHCACTMTCACT | 521 | 1145 |
| VK1-39_12_1_8 | CCTGAAGATTTTGCAACTTACTACTGTCAGCAAVNATACAGTBHCMTCACTTTTGGCGGAGGGACCAAG | CAGCAAVNATACAGTBHCMTCACT | 522 | 1146 |
| VK1-39_13_1_8 | CCTGAAGATTTTGCAACTTACTACTGTCAGCAAAGCBHCNHCACTMTCACTTTTGGCGGAGGGACCAAG | CAGCAAAGCBHCNHCACTMTCACT | 523 | 1147 |
| VK1-39_14_1_8 | CCTGAAGATTTTGCAACTTACTACTGTCAGCAAAGCBHCAGTBHCMTCACTTTTGGCGGAGGGACCAAG | CAGCAAAGCBHCAGTBHCMTCACT | 524 | 1148 |
| VK1-39_15_1_8 | CCTGAAGATTTTGCAACTTACTACTGTCAGCAAAGCTACNHCBHCMTCACTTTTGGCGGAGGGACCAAG | CAGCAAAGCTACNHCBHCMTCACT | 525 | 1149 |
| VK1-39_2_1_8 | CCTGAAGATTTTGCAACTTACTACTGTSWMCAAVNATACAGTACTMTCACTTTTGGCGGAGGGACCAAG | SWMCAAVNATACAGTACTMTCACT | 526 | 1150 |
| VK1-39_3_1_8 | CCTGAAGATTTTGCAACTTACTACTGTSWMCAAAGCBHCAGTACTMTCACTTTTGGCGGAGGGACCAAG | SWMCAAAGCBHCAGTACTMTCACT | 527 | 1151 |
| VK1-39_4_1_8 | CCTGAAGATTTTGCAACTTACTACTGTSWMCAAAGCTACNHCACTMTCACTTTTGGCGGAGGGACCAAG | SWMCAAAGCTACNHCACTMTCACT | 528 | 1152 |
| VK1-39_5_1_8 | CCTGAAGATTTTGCAACTTACTACTGTSWMCAAAGCTACAGTBHCMTCACTTTTGGCGGAGGGACCAAG | SWMCAAAGCTACAGTBHCMTCACT | 529 | 1153 |
| VK1-39_6_1_8 | CCTGAAGATTTTGCAACTTACTACTGTCAGSWMVNATACAGTACTMTCACTTTTGGCGGAGGGACCAAG | CAGSWMVNATACAGTACTMTCACT | 530 | 1154 |
| VK1-39_7_1_8 | CCTGAAGATTTTGCAACTTACTACTGTCAGSWMAGCBHCAGTACTMTCACTTTTGGCGGAGGGACCAAG | CAGSWMAGCBHCAGTACTMTCACT | 531 | 1155 |
| VK1-39_8_1_8 | CCTGAAGATTTTGCAACTTACTACTGTCAGSWMAGCTACNHCACTMTCACTTTTGGCGGAGGGACCAAG | CAGSWMAGCTACNHCACTMTCACT | 532 | 1156 |
| VK1-39_9_1_8 | CCTGAAGATTTTGCAACTTACTACTGTCAGSWMAGCTACAGTBHCMTCACTTTTGGCGGAGGGACCAAG | CAGSWMAGCTACAGTBHCMTCACT | 533 | 1157 |
| VK1-39_1_2_8 | CCTGAAGATTTTGCAACTTACTACTGTSWMSWMAGCTACAGTACTWGGACTTTTGGCGGAGGGACCAAG | SWMSWMAGCTACAGTACTWGGACT | 534 | 1158 |
| VK1-39_10_2_8 | CCTGAAGATTTTGCAACTTACTACTGTCAGCAAVNABHCAGTACTWGGACTTTTGGCGGAGGGACCAAG | CAGCAAVNABHCAGTACTWGGACT | 535 | 1159 |
| VK1-39_11_2_8 | CCTGAAGATTTTGCAACTTACTACTGTCAGCAAVNATACNHCACTWGGACTTTTGGCGGAGGGACCAAG | CAGCAAVNATACNHCACTWGGACT | 536 | 1160 |
| VK1-39_12_2_8 | CCTGAAGATTTTGCAACTTACTACTGTCAGCAAVNATACAGTBHCWGGACTTTTGGCGGAGGGACCAAG | CAGCAAVNATACAGTBHCWGGACT | 537 | 1161 |
| VK1-39_13_2_8 | CCTGAAGATTTTGCAACTTACTACTGTCAGCAAAGCBHCNHCACTWGGACTTTTGGCGGAGGGACCAAG | CAGCAAAGCBHCNHCACTWGGACT | 538 | 1162 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_14_2_8 | CCTGAAGATTTTGCAACTTACTACTGTCAGCAAAGCBHCAGTBHCWGGACTTTTGGCGGAGGGACCAAG | CAGCAAAGCBHCAGTBHCWGGACT | 539 | 1163 |
| VK1-39_15_2_8 | CCTGAAGATTTTGCAACTTACTACTGTCAGCAAAGCTACNHCBHCWGGACTACNHCBHCWGGACTTTTGGCGGAGGGACCAAG | CAGCAAAGCTACNHCBHCWGGACT | 540 | 1164 |
| VK1-39_2_2_8 | CCTGAAGATTTTGCAACTTACTACTGTSWMCAAVNATACAGTACTWGGACTTTTGGCGGAGGGACCAAG | SWMCAAVNATACAGTACTWGGACT | 541 | 1165 |
| VK1-39_3_2_8 | CCTGAAGATTTTGCAACTTACTACTGTSWMCAAAGCBHCAGTACTWGGACTTTTGGCGGAGGGACCAAG | SWMCAAAGCBHCAGTACTWGGACT | 542 | 1166 |
| VK1-39_4_2_8 | CCTGAAGATTTTGCAACTTACTACTGTSWMCAAAGCTACNHCACTWGGACTTTTGGCGGAGGGACCAAG | SWMCAAAGCTACNHCACTWGGACT | 543 | 1167 |
| VK1-39_5_2_8 | CCTGAAGATTTTGCAACTTACTACTGTSWMCAAAGCTACAGTBHCWGGACTTTTGGCGGAGGGACCAAG | SWMCAAAGCTACAGTBHCWGGACT | 544 | 1168 |
| VK1-39_6_2_8 | CCTGAAGATTTTGCAACTTACTACTGTCAGSWMVNATACAGTACTWGGACTTTTGGCGGAGGGACCAAG | CAGSWMVNATACAGTACTWGGACT | 545 | 1169 |
| VK1-39_7_2_8 | CCTGAAGATTTTGCAACTTACTACTGTCAGSWMAGCBHCAGTACTWGGACTTTTGGCGGAGGGACCAAG | CAGSWMAGCBHCAGTACTWGGACT | 546 | 1170 |
| VK1-39_8_2_8 | CCTGAAGATTTTGCAACTTACTACTGTCAGSWMAGCTACNHCACTWGGACTTTTGGCGGAGGGACCAAG | CAGSWMAGCTACNHCACTWGGACT | 547 | 1171 |
| VK1-39_9_2_8 | CCTGAAGATTTTGCAACTTACTACTGTCAGSWMAGCTACAGTBHCWGGACTTTTGGCGGAGGGACCAAG | CAGSWMAGCTACAGTBHCWGGACT | 548 | 1172 |
| VK1-39_1_3_8 | CCTGAAGATTTTGCAACTTACTACTGTSWMSWMAGCTACAGTACTCCTACTTTTGGCGGAGGGACCAAG | SWMSWMAGCTACAGTACTCCTACT | 549 | 1173 |
| VK1-39_10_3_8 | CCTGAAGATTTTGCAACTTACTACTGTCAGCAAVNABHCAGTACTCCTACTTTTGGCGGAGGGACCAAG | CAGCAAVNABHCAGTACTCCTACT | 550 | 1174 |
| VK1-39_11_3_8 | CCTGAAGATTTTGCAACTTACTACTGTCAGCAAVNATACNHCACTCCTACTTTTGGCGGAGGGACCAAG | CAGCAAVNATACNHCACTCCTACT | 551 | 1175 |
| VK1-39_12_3_8 | CCTGAAGATTTTGCAACTTACTACTGTCAGCAAVNATACAGTBHCCCTACTTTTGGCGGAGGGACCAAG | CAGCAAVNATACAGTBHCCCTACT | 552 | 1176 |
| VK1-39_13_3_8 | CCTGAAGATTTTGCAACTTACTACTGTCAGCAAAGCBHCNHCACTCCTACTTTTGGCGGAGGGACCAAG | CAGCAAAGCBHCNHCACTCCTACT | 553 | 1177 |
| VK1-39_14_3_8 | CCTGAAGATTTTGCAACTTACTACTGTCAGCAAAGCBHCAGTBHCCCTACTTTTGGCGGAGGGACCAAG | CAGCAAAGCBHCAGTBHCCCTACT | 554 | 1178 |
| VK1-39_15_3_8 | CCTGAAGATTTTGCAACTTACTACTGTCAGCAAAGCTACNHCBHCCCTACTTTTGGCGGAGGGACCAAG | CAGCAAAGCTACNHCBHCCCTACT | 555 | 1179 |
| VK1-39_2_3_8 | CCTGAAGATTTTGCAACTTACTACTGTSWMCAAVNATACAGTACTCCTACTTTTGGCGGAGGGACCAAG | SWMCAAVNATACAGTACTCCTACT | 556 | 1180 |
| VK1-39_3_3_8 | CCTGAAGATTTTGCAACTTACTACTGTSWMCAAAGCBHCAGTACTCCTACTTTTGGCGGAGGGACCAAG | SWMCAAAGCBHCAGTACTCCTACT | 557 | 1181 |
| VK1-39_4_3_8 | CCTGAAGATTTTGCAACTTACTACTGTSWMCAAAGCTACNHCACTCCTACTTTTGGCGGAGGGACCAAG | SWMCAAAGCTACNHCACTCCTACT | 558 | 1182 |
| VK1-39_5_3_8 | CCTGAAGATTTTGCAACTTACTACTGTSWMCAAAGCTACAGTBHCCCTACTTTTGGCGGAGGGACCAAG | SWMCAAAGCTACAGTBHCCCTACT | 559 | 1183 |
| VK1-39_6_3_8 | CCTGAAGATTTTGCAACTTACTACTGTCAGSWMVNATACAGTACTCCTACTTTTGGCGGAGGGACCAAG | CAGSWMVNATACAGTACTCCTACT | 560 | 1184 |
| VK1-39_7_3_8 | CCTGAAGATTTTGCAACTTACTACTGTCAGSWMAGCBHCAGTACTCCTACTTTTGGCGGAGGGACCAAG | CAGSWMAGCBHCAGTACTCCTACT | 561 | 1185 |
| VK1-39_8_3_8 | CCTGAAGATTTTGCAACTTACTACTGTCAGSWMAGCTACNHCACTCCTACTTTTGGCGGAGGGACCAAG | CAGSWMAGCTACNHCACTCCTACT | 562 | 1186 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_9_3_8 | CCTGAAGATTTTGCAACTTACTACTGTCAGSWMAGCTACAGTBHCCCTACTTTTGGCGGAGGGACCAAG | CAGSWMAGCTACAGTBHCCCTACT | 563 | 1187 |
| VK2-28_1_0_8 | GCTGAGGATGTTGGGGTTTATTACTGCDTSSWMGCACTCCAGACTTWCACTTTTGGCGGAGGGACCAAG | DTSSWMGCACTCCAGACTTWCACT | 564 | 1188 |
| VK2-28_10_0_8 | GCTGAGGATGTTGGGGTTTATTACTGCATGCAGVNAMNACAGACTTWCACTTTTGGCGGAGGGACCAAG | ATGCAGVNAMNACAGACTTWCACT | 565 | 1189 |
| VK2-28_11_0_8 | GCTGAGGATGTTGGGGTTTATTACTGCATGCAGVNACTCSRMACTTWCACTTTTGGCGGAGGGACCAAG | ATGCAGVNACTCSRMACTTWCACT | 566 | 1190 |
| VK2-28_12_0_8 | GCTGAGGATGTTGGGGTTTATTACTGCATGCAGVNACTCCAGVBCTWCACTTTTGGCGGAGGGACCAAG | ATGCAGVNACTCCAGVBCTWCACT | 567 | 1191 |
| VK2-28_13_0_8 | GCTGAGGATGTTGGGGTTTATTACTGCATGCAGGCAMNASRMACTTWCACTTTTGGCGGAGGGACCAAG | ATGCAGGCAMNASRMACTTWCACT | 568 | 1192 |
| VK2-28_14_0_8 | GCTGAGGATGTTGGGGTTTATTACTGCATGCAGGCAMNACAGVBCTWCACTTTTGGCGGAGGGACCAAG | ATGCAGGCAMNACAGVBCTWCACT | 569 | 1193 |
| VK2-28_15_0_8 | GCTGAGGATGTTGGGGTTTATTACTGCATGCAGGCACTCSRMVBCTWCACTTTTGGCGGAGGGACCAAG | ATGCAGGCACTCSRMVBCTWCACT | 570 | 1194 |
| VK2-28_2_0_8 | GCTGAGGATGTTGGGGTTTATTACTGCDTSCAGVNACTCCAGACTTWCACTTTTGGCGGAGGGACCAAG | DTSCAGVNACTCCAGACTTWCACT | 571 | 1195 |
| VK2-28_3_0_8 | GCTGAGGATGTTGGGGTTTATTACTGCDTSCAGGCAMNACAGACTTWCACTTTTGGCGGAGGGACCAAG | DTSCAGGCAMNACAGACTTWCACT | 572 | 1196 |
| VK2-28_4_0_8 | GCTGAGGATGTTGGGGTTTATTACTGCDTSCAGGCACTCSRMACTTWCACTTTTGGCGGAGGGACCAAG | DTSCAGGCACTCSRMACTTWCACT | 573 | 1197 |
| VK2-28_5_0_8 | GCTGAGGATGTTGGGGTTTATTACTGCDTSCAGGCACTCCAGVBCTWCACTTTTGGCGGAGGGACCAAG | DTSCAGGCACTCCAGVBCTWCACT | 574 | 1198 |
| VK2-28_6_0_8 | GCTGAGGATGTTGGGGTTTATTACTGCATGSWMVNACTCCAGACTTWCACTTTTGGCGGAGGGACCAAG | ATGSWMVNACTCCAGACTTWCACT | 575 | 1199 |
| VK2-28_7_0_8 | GCTGAGGATGTTGGGGTTTATTACTGCATGSWMGCAMNACAGACTTWCACTTTTGGCGGAGGGACCAAG | ATGSWMGCAMNACAGACTTWCACT | 576 | 1200 |
| VK2-28_8_0_8 | GCTGAGGATGTTGGGGTTTATTACTGCATGSWMGCACTCSRMACTTWCACTTTTGGCGGAGGGACCAAG | ATGSWMGCACTCSRMACTTWCACT | 577 | 1201 |
| VK2-28_9_0_8 | GCTGAGGATGTTGGGGTTTATTACTGCATGSWMGCACTCCAGVBCTWCACTTTTGGCGGAGGGACCAAG | ATGSWMGCACTCCAGVBCTWCACT | 578 | 1202 |
| VK2-28_1_1_8 | GCTGAGGATGTTGGGGTTTATTACTGCDTSSWMGCACTCCAGACTMTCACTTTTGGCGGAGGGACCAAG | DTSSWMGCACTCCAGACTMTCACT | 579 | 1203 |
| VK2-28_10_1_8 | GCTGAGGATGTTGGGGTTTATTACTGCATGCAGVNAMNACAGACTMTCACTTTTGGCGGAGGGACCAAG | ATGCAGVNAMNACAGACTMTCACT | 580 | 1204 |
| VK2-28_11_1_8 | GCTGAGGATGTTGGGGTTTATTACTGCATGCAGVNACTCSRMACTMTCACTTTTGGCGGAGGGACCAAG | ATGCAGVNACTCSRMACTMTCACT | 581 | 1205 |
| VK2-28_12_1_8 | GCTGAGGATGTTGGGGTTTATTACTGCATGCAGVNACTCCAGVBCMTCACTTTTGGCGGAGGGACCAAG | ATGCAGVNACTCCAGVBCMTCACT | 582 | 1206 |
| VK2-28_13_1_8 | GCTGAGGATGTTGGGGTTTATTACTGCATGCAGGCAMNASRMACTMTCACTTTTGGCGGAGGGACCAAG | ATGCAGGCAMNASRMACTMTCACT | 583 | 1207 |
| VK2-28_14_1_8 | GCTGAGGATGTTGGGGTTTATTACTGCATGCAGGCAMNACAGVBCMTCACTTTTGGCGGAGGGACCAAG | ATGCAGGCAMNACAGVBCMTCACT | 584 | 1208 |
| VK2-28_15_1_8 | GCTGAGGATGTTGGGGTTTATTACTGCATGCAGGCACTCSRMVBCMTCACTTTTGGCGGAGGGACCAAG | ATGCAGGCACTCSRMVBCMTCACT | 585 | 1209 |
| VK2-28_2_1_8 | GCTGAGGATGTTGGGGTTTATTACTGCDTSCAGVNACTCCAGACTMTCACTTTTGGCGGAGGGACCAAG | DTSCAGVNACTCCAGACTMTCACT | 586 | 1210 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_3_1_8 | GCTGAGGATGTTGGGGTTTATTACTGCDTSCAGGCAM NACAGACTMTCACTTTTGGCGGAGGGACCAAG | DTSCAGGCAMNACAGACTMTCACT | 587 | 1211 |
| VK2-28_4_1_8 | GCTGAGGATGTTGGGGTTTATTACTGCDTSCAGGCAC TCSRMACTMTCACTTTTGGCGGAGGGACCAAG | DTSCAGGCACTCSRMACTMTCACT | 588 | 1212 |
| VK2-28_5_1_8 | GCTGAGGATGTTGGGGTTTATTACTGCDTSCAGGCAC TCCAGVBCMTCACTTTTGGCGGAGGGACCAAG | DTSCAGGCACTCCAGVBCMTCACT | 589 | 1213 |
| VK2-28_6_1_8 | GCTGAGGATGTTGGGGTTTATTACTGCATGSWMVNAC TCCAGACTMTCACTTTTGGCGGAGGGACCAAG | ATGSWMVNACTCCAGACTMTCACT | 590 | 1214 |
| VK2-28_7_1_8 | GCTGAGGATGTTGGGGTTTATTACTGCATGSWMGCAM NACAGACTMTCACTTTTGGCGGAGGGACCAAG | ATGSWMGCAMNACAGACTMTCACT | 591 | 1215 |
| VK2-28_8_1_8 | GCTGAGGATGTTGGGGTTTATTACTGCATGSWMGCAC TCSRMACTMTCACTTTTGGCGGAGGGACCAAG | ATGSWMGCACTCSRMACTMTCACT | 592 | 1216 |
| VK2-28_9_1_8 | GCTGAGGATGTTGGGGTTTATTACTGCATGSWMGCAC TCCAGVBCMTCACTTTTGGCGGAGGGACCAAG | ATGSWMGCACTCCAGVBCMTCACT | 593 | 1217 |
| VK2-28_1_2_8 | GCTGAGGATGTTGGGGTTTATTACTGCDTSSWMGCAC TCCAGACTWGGACTTTTGGCGGAGGGACCAAG | DTSSWMGCACTCCAGACTWGGACT | 594 | 1218 |
| VK2-28_10_2_8 | GCTGAGGATGTTGGGGTTTATTACTGCATGCAGVNAM NACAGACTWGGACTTTTGGCGGAGGGACCAAG | ATGCAGVNAMNACAGACTWGGACT | 595 | 1219 |
| VK2-28_11_2_8 | GCTGAGGATGTTGGGGTTTATTACTGCATGCAGVNAC TCSRMACTWGGACTTTTGGCGGAGGGACCAAG | ATGCAGVNACTCSRMACTWGGACT | 596 | 1220 |
| VK2-28_12_2_8 | GCTGAGGATGTTGGGGTTTATTACTGCATGCAGVNAC TCCAGVBCWGGACTTTTGGCGGAGGGACCAAG | ATGCAGVNACTCCAGVBCWGGACT | 597 | 1221 |
| VK2-28_13_2_8 | GCTGAGGATGTTGGGGTTTATTACTGCATGCAGGCAM NASRMACTWGGACTTTTGGCGGAGGGACCAAG | ATGCAGGCAMNASRMACTWGGACT | 598 | 1222 |
| VK2-28_14_2_8 | GCTGAGGATGTTGGGGTTTATTACTGCATGCAGGCAM NACAGVBCWGGACTTTTGGCGGAGGGACCAAG | ATGCAGGCAMNACAGVBCWGGACT | 599 | 1223 |
| VK2-28_15_2_8 | GCTGAGGATGTTGGGGTTTATTACTGCATGCAGGCAC TCSRMVBCWGGACTTTTGGCGGAGGGACCAAG | ATGCAGGCACTCSRMVBCWGGACT | 600 | 1224 |
| VK2-28_2_2_8 | GCTGAGGATGTTGGGGTTTATTACTGCDTSCAGVNAC TCCAGACTWGGACTTTTGGCGGAGGGACCAAG | DTSCAGVNACTCCAGACTWGGACT | 601 | 1225 |
| VK2-28_3_2_8 | GCTGAGGATGTTGGGGTTTATTACTGCDTSCAGGCAM NACAGACTWGGACTTTTGGCGGAGGGACCAAG | DTSCAGGCAMNACAGACTWGGACT | 602 | 1226 |
| VK2-28_4_2_8 | GCTGAGGATGTTGGGGTTTATTACTGCDTSCAGGCAC TCSRMACTWGGACTTTTGGCGGAGGGACCAAG | DTSCAGGCACTCSRMACTWGGACT | 603 | 1227 |
| VK2-28_5_2_8 | GCTGAGGATGTTGGGGTTTATTACTGCDTSCAGGCAC TCCAGVBCWGGACTTTTGGCGGAGGGACCAAG | DTSCAGGCACTCCAGVBCWGGACT | 604 | 1228 |
| VK2-28_6_2_8 | GCTGAGGATGTTGGGGTTTATTACTGCATGSWMVNAC TCCAGACTWGGACTTTTGGCGGAGGGACCAAG | ATGSWMVNACTCCAGACTWGGACT | 605 | 1229 |
| VK2-28_7_2_8 | GCTGAGGATGTTGGGGTTTATTACTGCATGSWMGCAM NACAGACTWGGACTTTTGGCGGAGGGACCAAG | ATGSWMGCAMNACAGACTWGGACT | 606 | 1230 |
| VK2-28_8_2_8 | GCTGAGGATGTTGGGGTTTATTACTGCATGSWMGCAC TCSRMACTWGGACTTTTGGCGGAGGGACCAAG | ATGSWMGCACTCSRMACTWGGACT | 607 | 1231 |
| VK2-28_9_2_8 | GCTGAGGATGTTGGGGTTTATTACTGCATGSWMGCAC TCCAGVBCWGGACTTTTGGCGGAGGGACCAAG | ATGSWMGCACTCCAGVBCWGGACT | 608 | 1232 |
| VK2-28_1_3_8 | GCTGAGGATGTTGGGGTTTATTACTGCDTSSWMGCAC TCCAGACTCCTACTTTTGGCGGAGGGACCAAG | DTSSWMGCACTCCAGACTCCTACT | 609 | 1233 |
| VK2-28_10_3_8 | GCTGAGGATGTTGGGGTTTATTACTGCATGCAGVNAM NACAGACTCCTACTTTTGGCGGAGGGACCAAG | ATGCAGVNAMNACAGACTCCTACT | 610 | 1234 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_11_3_8 | GCTGAGGATGTTGGGGTTTATTACTGCATGCAGVNACTCSRMACTCCTACTTTTGGCGGAGGGACCAAG | ATGCAGVNACTCSRMACTCCTACT | 611 | 1235 |
| VK2-28_12_3_8 | GCTGAGGATGTTGGGGTTTATTACTGCATGCAGVNACTCCAGVBCCCTACTTTTGGCGGAGGGACCAAG | ATGCAGVNACTCCAGVBCCCTACT | 612 | 1236 |
| VK2-28_13_3_8 | GCTGAGGATGTTGGGGTTTATTACTGCATGCAGGCAMNASRMACTCCTACTTTTGGCGGAGGGACCAAG | ATGCAGGCAMNASRMACTCCTACT | 613 | 1237 |
| VK2-28_14_3_8 | GCTGAGGATGTTGGGGTTTATTACTGCATGCAGGCAMNACAGVBCCCTACTTTTGGCGGAGGGACCAAG | ATGCAGGCAMNACAGVBCCCTACT | 614 | 1238 |
| VK2-28_15_3_8 | GCTGAGGATGTTGGGGTTTATTACTGCATGCAGGCACTCSRMVBCCCTACTTTTGGCGGAGGGACCAAG | ATGCAGGCACTCSRMVBCCCTACT | 615 | 1239 |
| VK2-28_2_3_8 | GCTGAGGATGTTGGGGTTTATTACTGCDTSCAGVNACTCCAGACTCCTACTTTTGGCGGAGGGACCAAG | DTSCAGVNACTCCAGACTCCTACT | 616 | 1240 |
| VK2-28_3_3_8 | GCTGAGGATGTTGGGGTTTATTACTGCDTSCAGGCAMNACAGACTCCTACTTTTGGCGGAGGGACCAAG | DTSCAGGCAMNACAGACTCCTACT | 617 | 1241 |
| VK2-28_4_3_8 | GCTGAGGATGTTGGGGTTTATTACTGCDTSCAGGCACTCSRMACTCCTACTTTTGGCGGAGGGACCAAG | DTSCAGGCACTCSRMACTCCTACT | 618 | 1242 |
| VK2-28_5_3_8 | GCTGAGGATGTTGGGGTTTATTACTGCDTSCAGGCACTCCAGVBCCCTACTTTTGGCGGAGGGACCAAG | DTSCAGGCACTCCAGVBCCCTACT | 619 | 1243 |
| VK2-28_6_3_8 | GCTGAGGATGTTGGGGTTTATTACTGCATGSWMVNACTCCAGACTCCTACTTTTGGCGGAGGGACCAAG | ATGSWMVNACTCCAGACTCCTACT | 620 | 1244 |
| VK2-28_7_3_8 | GCTGAGGATGTTGGGGTTTATTACTGCATGSWMGCAMNACAGACTCCTACTTTTGGCGGAGGGACCAAG | ATGSWMGCAMNACAGACTCCTACT | 621 | 1245 |
| VK2-28_8_3_8 | GCTGAGGATGTTGGGGTTTATTACTGCATGSWMGCACTCSRMACTCCTACTTTTGGCGGAGGGACCAAG | ATGSWMGCACTCSRMACTCCTACT | 622 | 1246 |
| VK2-28_9_3_8 | GCTGAGGATGTTGGGGTTTATTACTGCATGSWMGCACTCCAGVBCCCTACTTTTGGCGGAGGGACCAAG | ATGSWMGCACTCCAGVBCCCTACT | 623 | 1247 |
| VK3-11_1_0_8 | CCTGAAGATTTTGCAGTTTATTACTGTSWMSWMAGAAGTAATTGGTWCACTTTTGGCGGAGGGACCAAG | SWMSWMAGAAGTAATTGGTWCACT | 624 | 1248 |
| VK3-11_10_0_8 | CCTGAAGATTTTGCAGTTTATTACTGTCAGCAGBHCNHCAATTGGTWCACTTTTGGCGGAGGGACCAAG | CAGCAGBHCNHCAATTGGTWCACT | 625 | 1249 |
| VK3-11_11_0_8 | CCTGAAGATTTTGCAGTTTATTACTGTCAGCAGBHCAGTNHCTGGTWCACTTTTGGCGGAGGGACCAAG | CAGCAGBHCAGTNHCTGGTWCACT | 626 | 1250 |
| VK3-11_12_0_8 | CCTGAAGATTTTGCAGTTTATTACTGTCAGCAGBHCAGTAATYWCTWCACTTTTGGCGGAGGGACCAAG | CAGCAGBHCAGTAATYWCTWCACT | 627 | 1251 |
| VK3-11_13_0_8 | CCTGAAGATTTTGCAGTTTATTACTGTCAGCAGAGANHCNHCTGGTWCACTTTTGGCGGAGGGACCAAG | CAGCAGAGANHCNHCTGGTWCACT | 628 | 1252 |
| VK3-11_14_0_8 | CCTGAAGATTTTGCAGTTTATTACTGTCAGCAGAGANHCAATYWCTWCACTTTTGGCGGAGGGACCAAG | CAGCAGAGANHCAATYWCTWCACT | 629 | 1253 |
| VK3-11_15_0_8 | CCTGAAGATTTTGCAGTTTATTACTGTCAGCAGAGAAGTNHCYWCTWCACTTTTGGCGGAGGGACCAAG | CAGCAGAGAAGTNHCYWCTWCACT | 630 | 1254 |
| VK3-11_2_0_8 | CCTGAAGATTTTGCAGTTTATTACTGTSWMCAGBHCAGTAATTGGTWCACTTTTGGCGGAGGGACCAAG | SWMCAGBHCAGTAATTGGTWCACT | 631 | 1255 |
| VK3-11_3_0_8 | CCTGAAGATTTTGCAGTTTATTACTGTSWMCAGAGANHCAATTGGTWCACTTTTGGCGGAGGGACCAAG | SWMCAGAGANHCAATTGGTWCACT | 632 | 1256 |
| VK3-11_4_0_8 | CCTGAAGATTTTGCAGTTTATTACTGTSWMCAGAGAAGTNHCTGGTWCACTTTTGGCGGAGGGACCAAG | SWMCAGAGAAGTNHCTGGTWCACT | 633 | 1257 |
| VK3-11_5_0_8 | CCTGAAGATTTTGCAGTTTATTACTGTSWMCAGAGAAGTAATYWCTWCACTTTTGGCGGAGGGACCAAG | SWMCAGAGAAGTAATYWCTWCACT | 634 | 1258 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_6_0_8 | CCTGAAGATTTTGCAGTTTATTACTGTCAGSWMBHCAGTAATTGGTWCACTTTTGGCGGAGGGACCAAG | CAGSWMBHCAGTAATTGGTWCACT | 635 | 1259 |
| VK3-11_7_0_8 | CCTGAAGATTTTGCAGTTTATTACTGTCAGSWMAGANHCAATTGGTWCACTTTTGGCGGAGGGACCAAG | CAGSWMAGANHCAATTGGTWCACT | 636 | 1260 |
| VK3-11_8_0_8 | CCTGAAGATTTTGCAGTTTATTACTGTCAGSWMAGAAGTNHCTGGTWCACTTTTGGCGGAGGGACCAAG | CAGSWMAGAAGTNHCTGGTWCACT | 637 | 1261 |
| VK3-11_9_0_8 | CCTGAAGATTTTGCAGTTTATTACTGTCAGSWMAGAAGTAATYWCTWCACTTTTGGCGGAGGGACCAAG | CAGSWMAGAAGTAATYWCTWCACT | 638 | 1262 |
| VK3-11_1_1_8 | CCTGAAGATTTTGCAGTTTATTACTGTSWMSWMAGAAGTAATTGGMTCACTTTTGGCGGAGGGACCAAG | SWMSWMAGAAGTAATTGGMTCACT | 639 | 1263 |
| VK3-11_10_1_8 | CCTGAAGATTTTGCAGTTTATTACTGTCAGCAGBHCNHCAATTGGMTCACTTTTGGCGGAGGGACCAAG | CAGCAGBHCNHCAATTGGMTCACT | 640 | 1264 |
| VK3-11_11_1_8 | CCTGAAGATTTTGCAGTTTATTACTGTCAGCAGBHCAGTNHCTGGMTCACTTTTGGCGGAGGGACCAAG | CAGCAGBHCAGTNHCTGGMTCACT | 641 | 1265 |
| VK3-11_12_1_8 | CCTGAAGATTTTGCAGTTTATTACTGTCAGCAGBHCAGTAATYWCMTCACTTTTGGCGGAGGGACCAAG | CAGCAGBHCAGTAATYWCMTCACT | 642 | 1266 |
| VK3-11_13_1_8 | CCTGAAGATTTTGCAGTTTATTACTGTCAGCAGAGANHCNHCTGGMTCACTTTTGGCGGAGGGACCAAG | CAGCAGAGANHCNHCTGGMTCACT | 643 | 1267 |
| VK3-11_14_1_8 | CCTGAAGATTTTGCAGTTTATTACTGTCAGCAGAGANHCAATYWCMTCACTTTTGGCGGAGGGACCAAG | CAGCAGAGANHCAATYWCMTCACT | 644 | 1268 |
| VK3-11_15_1_8 | CCTGAAGATTTTGCAGTTTATTACTGTCAGCAGAGAAGTNHCYWCMTCACTTTTGGCGGAGGGACCAAG | CAGCAGAGAAGTNHCYWCMTCACT | 645 | 1269 |
| VK3-11_2_1_8 | CCTGAAGATTTTGCAGTTTATTACTGTSWMCAGBHCAGTAATTGGMTCACTTTTGGCGGAGGGACCAAG | SWMCAGBHCAGTAATTGGMTCACT | 646 | 1270 |
| VK3-11_3_1_8 | CCTGAAGATTTTGCAGTTTATTACTGTSWMCAGAGANHCAATTGGMTCACTTTTGGCGGAGGGACCAAG | SWMCAGAGANHCAATTGGMTCACT | 647 | 1271 |
| VK3-11_4_1_8 | CCTGAAGATTTTGCAGTTTATTACTGTSWMCAGAGAAGTNHCTGGMTCACTTTTGGCGGAGGGACCAAG | SWMCAGAGAAGTNHCTGGMTCACT | 648 | 1272 |
| VK3-11_5_1_8 | CCTGAAGATTTTGCAGTTTATTACTGTSWMCAGAGAAGTAATYWCMTCACTTTTGGCGGAGGGACCAAG | SWMCAGAGAAGTAATYWCMTCACT | 649 | 1273 |
| VK3-11_6_1_8 | CCTGAAGATTTTGCAGTTTATTACTGTCAGSWMBHCAGTAATTGGMTCACTTTTGGCGGAGGGACCAAG | CAGSWMBHCAGTAATTGGMTCACT | 650 | 1274 |
| VK3-11_7_1_8 | CCTGAAGATTTTGCAGTTTATTACTGTCAGSWMAGANHCAATTGGMTCACTTTTGGCGGAGGGACCAAG | CAGSWMAGANHCAATTGGMTCACT | 651 | 1275 |
| VK3-11_8_1_8 | CCTGAAGATTTTGCAGTTTATTACTGTCAGSWMAGAAGTNHCTGGMTCACTTTTGGCGGAGGGACCAAG | CAGSWMAGAAGTNHCTGGMTCACT | 652 | 1276 |
| VK3-11_9_1_8 | CCTGAAGATTTTGCAGTTTATTACTGTCAGSWMAGAAGTAATYWCMTCACTTTTGGCGGAGGGACCAAG | CAGSWMAGAAGTAATYWCMTCACT | 653 | 1277 |
| VK3-11_1_2_8 | CCTGAAGATTTTGCAGTTTATTACTGTSWMSWMAGAAGTAATTGGWGACTTTTGGCGGAGGGACCAAG | SWMSWMAGAAGTAATTGGWGACT | 654 | 1278 |
| VK3-11_10_2_8 | CCTGAAGATTTTGCAGTTTATTACTGTCAGCAGBHCNHCAATTGGWGACTTTTGGCGGAGGGACCAAG | CAGCAGBHCNHCAATTGGWGACT | 655 | 1279 |
| VK3-11_11_2_8 | CCTGAAGATTTTGCAGTTTATTACTGTCAGCAGBHCAGTNHCTGGWGACTTTTGGCGGAGGGACCAAG | CAGCAGBHCAGTNHCTGGWGACT | 656 | 1280 |
| VK3-11_12_2_8 | CCTGAAGATTTTGCAGTTTATTACTGTCAGCAGBHCAGTAATYWCWGGACTTTTGGCGGAGGGACCAAG | CAGCAGBHCAGTAATYWCWGGACT | 657 | 1281 |
| VK3-11_13_2_8 | CCTGAAGATTTTGCAGTTTATTACTGTCAGCAGAGANHCNHCTGGWGACTTTTGGCGGAGGGACCAAG | CAGCAGAGANHCNHCTGGWGACT | 658 | 1282 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK3-11_14_2_8 | CCTGAAGATTTTGCAGTTTATTACTGTCAGCAGAGANHCAATYWCWGGACTTTTGGCGGAGGGACCAAG | CAGCAGAGANHCAATYWCWGGACT | 659 | 1283 |
| VK3-11_15_2_8 | CCTGAAGATTTTGCAGTTTATTACTGTCAGCAGAGAAGTNHCYWCWGGACTTTTGGCGGAGGGACCAAG | CAGCAGAGAAGTNHCYWCWGGACT | 660 | 1284 |
| VK3-11_2_2_8 | CCTGAAGATTTTGCAGTTTATTACTGTSWMCAGBHCAGTAATTGGWGGACTTTTGGCGGAGGGACCAAG | SWMCAGBHCAGTAATTGGWGGACT | 661 | 1285 |
| VK3-11_3_2_8 | CCTGAAGATTTTGCAGTTTATTACTGTSWMCAGAGANHCAATTGGWGGACTTTTGGCGGAGGGACCAAG | SWMCAGAGANHCAATTGGWGGACT | 662 | 1286 |
| VK3-11_4_2_8 | CCTGAAGATTTTGCAGTTTATTACTGTSWMCAGAGAAGTNHCTGGWGGACTTTTGGCGGAGGGACCAAG | SWMCAGAGAAGTNHCTGGWGGACT | 663 | 1287 |
| VK3-11_5_2_8 | CCTGAAGATTTTGCAGTTTATTACTGTSWMCAGAGAAGTAATYWCWGGACTTTTGGCGGAGGGACCAAG | SWMCAGAGAAGTAATYWCWGGACT | 664 | 1288 |
| VK3-11_6_2_8 | CCTGAAGATTTTGCAGTTTATTACTGTCAGSWMBHCAGTAATTGGWGGACTTTTGGCGGAGGGACCAAG | CAGSWMBHCAGTAATTGGWGGACT | 665 | 1289 |
| VK3-11_7_2_8 | CCTGAAGATTTTGCAGTTTATTACTGTCAGSWMAGANHCAATTGGWGGACTTTTGGCGGAGGGACCAAG | CAGSWMAGANHCAATTGGWGGACT | 666 | 1290 |
| VK3-11_8_2_8 | CCTGAAGATTTTGCAGTTTATTACTGTCAGSWMAGAAGTNHCTGGWGGACTTTTGGCGGAGGGACCAAG | CAGSWMAGAAGTNHCTGGWGGACT | 667 | 1291 |
| VK3-11_9_2_8 | CCTGAAGATTTTGCAGTTTATTACTGTCAGSWMAGAAGTAATYWCWGGACTTTTGGCGGAGGGACCAAG | CAGSWMAGAAGTAATYWCWGGACT | 668 | 1292 |
| VK3-11_1_3_8 | CCTGAAGATTTTGCAGTTTATTACTGTSWMSWMAGAAGTAATTGGCCTACTTTTGGCGGAGGGACCAAG | SWMSWMAGAAGTAATTGGCCTACT | 669 | 1293 |
| VK3-11_10_3_8 | CCTGAAGATTTTGCAGTTTATTACTGTCAGCAGBHCNHCAATTGGCCTACTTTTGGCGGAGGGACCAAG | CAGCAGBHCNHCAATTGGCCTACT | 670 | 1294 |
| VK3-11_11_3_8 | CCTGAAGATTTTGCAGTTTATTACTGTCAGCAGBHCAGTNHCTGGCCTACTTTTGGCGGAGGGACCAAG | CAGCAGBHCAGTNHCTGGCCTACT | 671 | 1295 |
| VK3-11_12_3_8 | CCTGAAGATTTTGCAGTTTATTACTGTCAGCAGBHCAGTAATYWCCCTACTTTTGGCGGAGGGACCAAG | CAGCAGBHCAGTAATYWCCCTACT | 672 | 1296 |
| VK3-11_13_3_8 | CCTGAAGATTTTGCAGTTTATTACTGTCAGCAGAGANHCNHCTGGCCTACTTTTGGCGGAGGGACCAAG | CAGCAGAGANHCNHCTGGCCTACT | 673 | 1297 |
| VK3-11_14_3_8 | CCTGAAGATTTTGCAGTTTATTACTGTCAGCAGAGANHCAATYWCCCTACTTTTGGCGGAGGGACCAAG | CAGCAGAGANHCAATYWCCCTACT | 674 | 1298 |
| VK3-11_15_3_8 | CCTGAAGATTTTGCAGTTTATTACTGTCAGCAGAGAAGTNHCYWCCCTACTTTTGGCGGAGGGACCAAG | CAGCAGAGAAGTNHCYWCCCTACT | 675 | 1299 |
| VK3-11_2_3_8 | CCTGAAGATTTTGCAGTTTATTACTGTSWMCAGBHCAGTAATTGGCCTACTTTTGGCGGAGGGACCAAG | SWMCAGBHCAGTAATTGGCCTACT | 676 | 1300 |
| VK3-11_3_3_8 | CCTGAAGATTTTGCAGTTTATTACTGTSWMCAGAGANHCAATTGGCCTACTTTTGGCGGAGGGACCAAG | SWMCAGAGANHCAATTGGCCTACT | 677 | 1301 |
| VK3-11_4_3_8 | CCTGAAGATTTTGCAGTTTATTACTGTSWMCAGAGAAGTNHCTGGCCTACTTTTGGCGGAGGGACCAAG | SWMCAGAGAAGTNHCTGGCCTACT | 678 | 1302 |
| VK3-11_5_3_8 | CCTGAAGATTTTGCAGTTTATTACTGTSWMCAGAGAAGTAATYWCCCTACTTTTGGCGGAGGGACCAAG | SWMCAGAGAAGTAATYWCCCTACT | 679 | 1303 |
| VK3-11_6_3_8 | CCTGAAGATTTTGCAGTTTATTACTGTCAGSWMBHCAGTAATTGGCCTACTTTTGGCGGAGGGACCAAG | CAGSWMBHCAGTAATTGGCCTACT | 680 | 1304 |
| VK3-11_7_3_8 | CCTGAAGATTTTGCAGTTTATTACTGTCAGSWMAGANHCAATTGGCCTACTTTTGGCGGAGGGACCAAG | CAGSWMAGANHCAATTGGCCTACT | 681 | 1305 |
| VK3-11_8_3_8 | CCTGAAGATTTTGCAGTTTATTACTGTCAGSWMAGAAGTNHCTGGCCTACTTTTGGCGGAGGGACCAAG | CAGSWMAGAAGTNHCTGGCCTACT | 682 | 1306 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_9_3_8 | CCTGAAGATTTTGCAGTTTATTACTGTCAGSWMAGAAGTAATYWCCCTACTTTTGGCGGAGGGACCAAG | CAGSWMAGAAGTAATYWCCCTACT | 683 | 1307 |
| VK3-15_1_0_8 | CAGTCTGAAGATTTTGCAGTTTATTACTGTSWMSWMTACAATAATTGGTWCACTTTTGGCGGAGGGACCAAG | SWMSWMTACAATAATTGGTWCACT | 684 | 1308 |
| VK3-15_10_0_8 | CAGTCTGAAGATTTTGCAGTTTATTACTGTCAGCAGBHCNHCAATTGGTWCACTTTTGGCGGAGGGACCAAG | CAGCAGBHCNHCAATTGGTWCACT | 685 | 1249 |
| VK3-15_11_0_8 | CAGTCTGAAGATTTTGCAGTTTATTACTGTCAGCAGBHCAATNHCTGGTWCACTTTTGGCGGAGGGACCAAG | CAGCAGBHCAATNHCTGGTWCACT | 686 | 1309 |
| VK3-15_12_0_8 | CAGTCTGAAGATTTTGCAGTTTATTACTGTCAGCAGBHCAATAATYWCTWCACTTTTGGCGGAGGGACCAAG | CAGCAGBHCAATAATYWCTWCACT | 687 | 1310 |
| VK3-15_13_0_8 | CAGTCTGAAGATTTTGCAGTTTATTACTGTCAGCAGTACNHCNHCTGGTWCACTTTTGGCGGAGGGACCAAG | CAGCAGTACNHCNHCTGGTWCACT | 688 | 1311 |
| VK3-15_14_0_8 | CAGTCTGAAGATTTTGCAGTTTATTACTGTCAGCAGTACNHCAATYWCTWCACTTTTGGCGGAGGGACCAAG | CAGCAGTACNHCAATYWCTWCACT | 689 | 1073 |
| VK3-15_15_0_8 | CAGTCTGAAGATTTTGCAGTTTATTACTGTCAGCAGTACAATNHCYWCTWCACTTTTGGCGGAGGGACCAAG | CAGCAGTACAATNHCYWCTWCACT | 690 | 1312 |
| VK3-15_2_0_8 | CAGTCTGAAGATTTTGCAGTTTATTACTGTSWMCAGBHCAATAATTGGTWCACTTTTGGCGGAGGGACCAAG | SWMCAGBHCAATAATTGGTWCACT | 691 | 1313 |
| VK3-15_3_0_8 | CAGTCTGAAGATTTTGCAGTTTATTACTGTSWMCAGTACNHCAATTGGTWCACTTTTGGCGGAGGGACCAAG | SWMCAGTACNHCAATTGGTWCACT | 692 | 1314 |
| VK3-15_4_0_8 | CAGTCTGAAGATTTTGCAGTTTATTACTGTSWMCAGTACAATNHCTGGTWCACTTTTGGCGGAGGGACCAAG | SWMCAGTACAATNHCTGGTWCACT | 693 | 1315 |
| VK3-15_5_0_8 | CAGTCTGAAGATTTTGCAGTTTATTACTGTSWMCAGTACAATAATYWCTWCACTTTTGGCGGAGGGACCAAG | SWMCAGTACAATAATYWCTWCACT | 694 | 1316 |
| VK3-15_6_0_8 | CAGTCTGAAGATTTTGCAGTTTATTACTGTCAGSWMBHCAATAATTGGTWCACTTTTGGCGGAGGGACCAAG | CAGSWMBHCAATAATTGGTWCACT | 695 | 1317 |
| VK3-15_7_0_8 | CAGTCTGAAGATTTTGCAGTTTATTACTGTCAGSWMTACNHCAATTGGTWCACTTTTGGCGGAGGGACCAAG | CAGSWMTACNHCAATTGGTWCACT | 696 | 1318 |
| VK3-15_8_0_8 | CAGTCTGAAGATTTTGCAGTTTATTACTGTCAGSWMTACAATNHCTGGTWCACTTTTGGCGGAGGGACCAAG | CAGSWMTACAATNHCTGGTWCACT | 697 | 1319 |
| VK3-15_9_0_8 | CAGTCTGAAGATTTTGCAGTTTATTACTGTCAGSWMTACAATAATYWCTWCACTTTTGGCGGAGGGACCAAG | CAGSWMTACAATAATYWCTWCACT | 698 | 1320 |
| VK3-15_1_1_8 | CAGTCTGAAGATTTTGCAGTTTATTACTGTSWMSWMTACAATAATTGGMTCACTTTTGGCGGAGGGACCAAG | SWMSWMTACAATAATTGGMTCACT | 699 | 1321 |
| VK3-15_10_1_8 | CAGTCTGAAGATTTTGCAGTTTATTACTGTCAGCAGBHCNHCAATTGGMTCACTTTTGGCGGAGGGACCAAG | CAGCAGBHCNHCAATTGGMTCACT | 700 | 1264 |
| VK3-15_11_1_8 | CAGTCTGAAGATTTTGCAGTTTATTACTGTCAGCAGBHCAATNHCTGGMTCACTTTTGGCGGAGGGACCAAG | CAGCAGBHCAATNHCTGGMTCACT | 701 | 1322 |
| VK3-15_12_1_8 | CAGTCTGAAGATTTTGCAGTTTATTACTGTCAGCAGBHCAATAATYWCMTCACTTTTGGCGGAGGGACCAAG | CAGCAGBHCAATAATYWCMTCACT | 702 | 1323 |
| VK3-15_13_1_8 | CAGTCTGAAGATTTTGCAGTTTATTACTGTCAGCAGTACNHCNHCTGGMTCACTTTTGGCGGAGGGACCAAG | CAGCAGTACNHCNHCTGGMTCACT | 703 | 1324 |
| VK3-15_14_1_8 | CAGTCTGAAGATTTTGCAGTTTATTACTGTCAGCAGTACNHCAATYWCMTCACTTTTGGCGGAGGGACCAAG | CAGCAGTACNHCAATYWCMTCACT | 704 | 1088 |
| VK3-15_15_1_8 | CAGTCTGAAGATTTTGCAGTTTATTACTGTCAGCAGTACAATNHCYWCMTCACTTTTGGCGGAGGGACCAAG | CAGCAGTACAATNHCYWCMTCACT | 705 | 1325 |
| VK3-15_2_1_8 | CAGTCTGAAGATTTTGCAGTTTATTACTGTSWMCAGBHCAATAATTGGMTCACTTTTGGCGGAGGGACCAAG | SWMCAGBHCAATAATTGGMTCACT | 706 | 1326 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-15_3_1_8 | CAGTCTGAAGATTTTGCAGTTTATTACTGTSWMCAGTACNHCAATTGGMTCACTTTTGGCGGAGGGACCAAG | SWMCAGTACNHCAATTGGMTCACT | 707 | 1327 |
| VK3-15_4_1_8 | CAGTCTGAAGATTTTGCAGTTTATTACTGTSWMCAGTACAATNHCTGGMTCACTTTTGGCGGAGGGACCAAG | SWMCAGTACAATNHCTGGMTCACT | 708 | 1328 |
| VK3-15_5_1_8 | CAGTCTGAAGATTTTGCAGTTTATTACTGTSWMCAGTACAATAATYWCMTCACTTTTGGCGGAGGGACCAAG | SWMCAGTACAATAATYWCMTCACT | 709 | 1329 |
| VK3-15_6_1_8 | CAGTCTGAAGATTTTGCAGTTTATTACTGTCAGSWMBHCAATAATTGGMTCACTTTTGGCGGAGGGACCAAG | CAGSWMBHCAATAATTGGMTCACT | 710 | 1330 |
| VK3-15_7_1_8 | CAGTCTGAAGATTTTGCAGTTTATTACTGTCAGSWMTACNHCAATTGGMTCACTTTTGGCGGAGGGACCAAG | CAGSWMTACNHCAATTGGMTCACT | 711 | 1331 |
| VK3-15_8_1_8 | CAGTCTGAAGATTTTGCAGTTTATTACTGTCAGSWMTACAATNHCTGGMTCACTTTTGGCGGAGGGACCAAG | CAGSWMTACAATNHCTGGMTCACT | 712 | 1332 |
| VK3-15_9_1_8 | CAGTCTGAAGATTTTGCAGTTTATTACTGTCAGSWMTACAATAATYWCMTCACTTTTGGCGGAGGGACCAAG | CAGSWMTACAATAATYWCMTCACT | 713 | 1333 |
| VK3-15_1_2_8 | CAGTCTGAAGATTTTGCAGTTTATTACTGTSWMSWMTACAATAATTGGWGGACTTTTGGCGGAGGGACCAAG | SWMSWMTACAATAATTGGWGGACT | 714 | 1334 |
| VK3-15_10_2_8 | CAGTCTGAAGATTTTGCAGTTTATTACTGTCAGCAGBHCNHCAATTGGWGGACTTTTGGCGGAGGGACCAAG | CAGCAGBHCNHCAATTGGWGGACT | 715 | 1279 |
| VK3-15_11_2_8 | CAGTCTGAAGATTTTGCAGTTTATTACTGTCAGCAGBHCAATNHCTGGWGGACTTTTGGCGGAGGGACCAAG | CAGCAGBHCAATNHCTGGWGGACT | 716 | 1335 |
| VK3-15_12_2_8 | CAGTCTGAAGATTTTGCAGTTTATTACTGTCAGCAGBHCAATAATYWCWGGACTTTTGGCGGAGGGACCAAG | CAGCAGBHCAATAATYWCWGGACT | 717 | 1336 |
| VK3-15_13_2_8 | CAGTCTGAAGATTTTGCAGTTTATTACTGTCAGCAGTACNHCNHCTGGWGGACTTTTGGCGGAGGGACCAAG | CAGCAGTACNHCNHCTGGWGGACT | 718 | 1337 |
| VK3-15_14_2_8 | CAGTCTGAAGATTTTGCAGTTTATTACTGTCAGCAGTACNHCAATYWCWGGACTTTTGGCGGAGGGACCAAG | CAGCAGTACNHCAATYWCWGGACT | 719 | 1103 |
| VK3-15_15_2_8 | CAGTCTGAAGATTTTGCAGTTTATTACTGTCAGCAGTACAATNHCYWCWGGACTTTTGGCGGAGGGACCAAG | CAGCAGTACAATNHCYWCWGGACT | 720 | 1338 |
| VK3-15_2_2_8 | CAGTCTGAAGATTTTGCAGTTTATTACTGTSWMCAGBHCAATAATTGGWGGACTTTTGGCGGAGGGACCAAG | SWMCAGBHCAATAATTGGWGGACT | 721 | 1339 |
| VK3-15_3_2_8 | CAGTCTGAAGATTTTGCAGTTTATTACTGTSWMCAGTACNHCAATTGGWGGACTTTTGGCGGAGGGACCAAG | SWMCAGTACNHCAATTGGWGGACT | 722 | 1340 |
| VK3-15_4_2_8 | CAGTCTGAAGATTTTGCAGTTTATTACTGTSWMCAGTACAATNHCTGGWGGACTTTTGGCGGAGGGACCAAG | SWMCAGTACAATNHCTGGWGGACT | 723 | 1341 |
| VK3-15_5_2_8 | CAGTCTGAAGATTTTGCAGTTTATTACTGTSWMCAGTACAATAATYWCWGGACTTTTGGCGGAGGGACCAAG | SWMCAGTACAATAATYWCWGGACT | 724 | 1342 |
| VK3-15_6_2_8 | CAGTCTGAAGATTTTGCAGTTTATTACTGTCAGSWMBHCAATAATTGGWGGACTTTTGGCGGAGGGACCAAG | CAGSWMBHCAATAATTGGWGGACT | 725 | 1343 |
| VK3-15_7_2_8 | CAGTCTGAAGATTTTGCAGTTTATTACTGTCAGSWMTACNHCAATTGGWGGACTTTTGGCGGAGGGACCAAG | CAGSWMTACNHCAATTGGWGGACT | 726 | 1344 |
| VK3-15_8_2_8 | CAGTCTGAAGATTTTGCAGTTTATTACTGTCAGSWMTACAATNHCTGGWGGACTTTTGGCGGAGGGACCAAG | CAGSWMTACAATNHCTGGWGGACT | 727 | 1345 |
| VK3-15_9_2_8 | CAGTCTGAAGATTTTGCAGTTTATTACTGTCAGSWMTACAATAATYWCWGGACTTTTGGCGGAGGGACCAAG | CAGSWMTACAATAATYWCWGGACT | 728 | 1346 |
| VK3-15_1_3_8 | CAGTCTGAAGATTTTGCAGTTTATTACTGTSWMSWMTACAATAATTGGCCTACTTTTGGCGGAGGGACCAAG | SWMSWMTACAATAATTGGCCTACT | 729 | 1347 |
| VK3-15_10_3_8 | CAGTCTGAAGATTTTGCAGTTTATTACTGTCAGCAGBHCNHCAATTGGCCTACTTTTGGCGGAGGGACCAAG | CAGCAGBHCNHCAATTGGCCTACT | 730 | 1294 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK3-15_11_3_8 | CAGTCTGAAGATTTTGCAGTTTATTACTGTCAGCAGBHCAATNHCTGGCCTACTTTTGGCGGAGGGACCAAG | CAGCAGBHCAATNHCTGGCCTACT | 731 | 1348 |
| VK3-15_12_3_8 | CAGTCTGAAGATTTTGCAGTTTATTACTGTCAGCAGBHCAATAATYWCCCTACTTTTGGCGGAGGGACCAAG | CAGCAGBHCAATAATYWCCCTACT | 732 | 1349 |
| VK3-15_13_3_8 | CAGTCTGAAGATTTTGCAGTTTATTACTGTCAGCAGTACNHCNHCTGGCCTACTTTTGGCGGAGGGACCAAG | CAGCAGTACNHCNHCTGGCCTACT | 733 | 1350 |
| VK3-15_14_3_8 | CAGTCTGAAGATTTTGCAGTTTATTACTGTCAGCAGTACNHCAATYWCCCTACTTTTGGCGGAGGGACCAAG | CAGCAGTACNHCAATYWCCCTACT | 734 | 1118 |
| VK3-15_15_3_8 | CAGTCTGAAGATTTTGCAGTTTATTACTGTCAGCAGTACAATNHCYWCCCTACTTTTGGCGGAGGGACCAAG | CAGCAGTACAATNHCYWCCCTACT | 735 | 1351 |
| VK3-15_2_3_8 | CAGTCTGAAGATTTTGCAGTTTATTACTGTSWMCAGBHCAATAATTGGCCTACTTTTGGCGGAGGGACCAAG | SWMCAGBHCAATAATTGGCCTACT | 736 | 1352 |
| VK3-15_3_3_8 | CAGTCTGAAGATTTTGCAGTTTATTACTGTSWMCAGTACNHCAATTGGCCTACTTTTGGCGGAGGGACCAAG | SWMCAGTACNHCAATTGGCCTACT | 737 | 1353 |
| VK3-15_4_3_8 | CAGTCTGAAGATTTTGCAGTTTATTACTGTSWMCAGTACAATNHCTGGCCTACTTTTGGCGGAGGGACCAAG | SWMCAGTACAATNHCTGGCCTACT | 738 | 1354 |
| VK3-15_5_3_8 | CAGTCTGAAGATTTTGCAGTTTATTACTGTSWMCAGTACAATAATYWCCCTACTTTTGGCGGAGGGACCAAG | SWMCAGTACAATAATYWCCCTACT | 739 | 1355 |
| VK3-15_6_3_8 | CAGTCTGAAGATTTTGCAGTTTATTACTGTCAGSWMBHCAATAATTGGCCTACTTTTGGCGGAGGGACCAAG | CAGSWMBHCAATAATTGGCCTACT | 740 | 1356 |
| VK3-15_7_3_8 | CAGTCTGAAGATTTTGCAGTTTATTACTGTCAGSWMTACNHCAATTGGCCTACTTTTGGCGGAGGGACCAAG | CAGSWMTACNHCAATTGGCCTACT | 741 | 1357 |
| VK3-15_8_3_8 | CAGTCTGAAGATTTTGCAGTTTATTACTGTCAGSWMTACAATNHCTGGCCTACTTTTGGCGGAGGGACCAAG | CAGSWMTACAATNHCTGGCCTACT | 742 | 1358 |
| VK3-15_9_3_8 | CAGTCTGAAGATTTTGCAGTTTATTACTGTCAGSWMTACAATAATYWCCCTACTTTTGGCGGAGGGACCAAG | CAGSWMTACAATAATYWCCCTACT | 743 | 1359 |
| VK3-20_1_0_8 | CCTGAAGATTTTGCAGTGTATTACTGTSWMSWMTACGGAAGTAGTTWCACTTTTGGCGGAGGGACCAAG | SWMSWMTACGGAAGTAGTTWCACT | 744 | 1360 |
| VK3-20_10_0_8 | CCTGAAGATTTTGCAGTGTATTACTGTCAGCAGBHCBHCAGTAGTTWCACTTTTGGCGGAGGGACCAAG | CAGCAGBHCBHCAGTAGTTWCACT | 745 | 1361 |
| VK3-20_11_0_8 | CCTGAAGATTTTGCAGTGTATTACTGTCAGCAGBHCGGAVNCAGTTWCACTTTTGGCGGAGGGACCAAG | CAGCAGBHCGGAVNCAGTTWCACT | 746 | 1362 |
| VK3-20_12_0_8 | CCTGAAGATTTTGCAGTGTATTACTGTCAGCAGBHCGGAAGTBHCTWCACTTTTGGCGGAGGGACCAAG | CAGCAGBHCGGAAGTBHCTWCACT | 747 | 1363 |
| VK3-20_13_0_8 | CCTGAAGATTTTGCAGTGTATTACTGTCAGCAGTACBHCVNCAGTTWCACTTTTGGCGGAGGGACCAAG | CAGCAGTACBHCVNCAGTTWCACT | 748 | 1364 |
| VK3-20_14_0_8 | CCTGAAGATTTTGCAGTGTATTACTGTCAGCAGTACBHCAGTBHCTWCACTTTTGGCGGAGGGACCAAG | CAGCAGTACBHCAGTBHCTWCACT | 749 | 1365 |
| VK3-20_15_0_8 | CCTGAAGATTTTGCAGTGTATTACTGTCAGCAGTACGGAVNCBHCTWCACTTTTGGCGGAGGGACCAAG | CAGCAGTACGGAVNCBHCTWCACT | 750 | 1366 |
| VK3-20_2_0_8 | CCTGAAGATTTTGCAGTGTATTACTGTSWMCAGBHCGGAAGTAGTTWCACTTTTGGCGGAGGGACCAAG | SWMCAGBHCGGAAGTAGTTWCACT | 751 | 1367 |
| VK3-20_3_0_8 | CCTGAAGATTTTGCAGTGTATTACTGTSWMCAGTACBHCAGTAGTTWCACTTTTGGCGGAGGGACCAAG | SWMCAGTACBHCAGTAGTTWCACT | 752 | 1368 |
| VK3-20_4_0_8 | CCTGAAGATTTTGCAGTGTATTACTGTSWMCAGTACGGAVNCAGTTWCACTTTTGGCGGAGGGACCAAG | SWMCAGTACGGAVNCAGTTWCACT | 753 | 1369 |
| VK3-20_5_0_8 | CCTGAAGATTTTGCAGTGTATTACTGTSWMCAGTACGGAAGTBHCTWCACTTTTGGCGGAGGGACCAAG | SWMCAGTACGGAAGTBHCTWCACT | 754 | 1370 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_6_0_8 | CCTGAAGATTTTGCAGTGTATTACTGTCAGSWMBHCGGAAGTAGTTWCACTTTTGGCGGAGGGACCAAG | CAGSWMBHCGGAAGTAGTTWCACT | 755 | 1371 |
| VK3-20_7_0_8 | CCTGAAGATTTTGCAGTGTATTACTGTCAGSWMTACBHCAGTAGTTWCACTTTTGGCGGAGGGACCAAG | CAGSWMTACBHCAGTAGTTWCACT | 756 | 1372 |
| VK3-20_8_0_8 | CCTGAAGATTTTGCAGTGTATTACTGTCAGSWMTACGGAVNCAGTTWCACTTTTGGCGGAGGGACCAAG | CAGSWMTACGGAVNCAGTTWCACT | 757 | 1373 |
| VK3-20_9_0_8 | CCTGAAGATTTTGCAGTGTATTACTGTCAGSWMTACGGAAGTBHCTWCACTTTTGGCGGAGGGACCAAG | CAGSWMTACGGAAGTBHCTWCACT | 758 | 1374 |
| VK3-20_1_1_8 | CCTGAAGATTTTGCAGTGTATTACTGTSWMSWMTACGGAAGTAGTMTCACTTTTGGCGGAGGGACCAAG | SWMSWMTACGGAAGTAGTMTCACT | 759 | 1375 |
| VK3-20_10_1_8 | CCTGAAGATTTTGCAGTGTATTACTGTCAGCAGBHCBHCAGTAGTMTCACTTTTGGCGGAGGGACCAAG | CAGCAGBHCBHCAGTAGTMTCACT | 760 | 1376 |
| VK3-20_11_1_8 | CCTGAAGATTTTGCAGTGTATTACTGTCAGCAGBHCGGAVNCAGTMTCACTTTTGGCGGAGGGACCAAG | CAGCAGBHCGGAVNCAGTMTCACT | 761 | 1377 |
| VK3-20_12_1_8 | CCTGAAGATTTTGCAGTGTATTACTGTCAGCAGBHCGGAAGTBHCMTCACTTTTGGCGGAGGGACCAAG | CAGCAGBHCGGAAGTBHCMTCACT | 762 | 1378 |
| VK3-20_13_1_8 | CCTGAAGATTTTGCAGTGTATTACTGTCAGCAGTACBHCVNCAGTMTCACTTTTGGCGGAGGGACCAAG | CAGCAGTACBHCVNCAGTMTCACT | 763 | 1379 |
| VK3-20_14_1_8 | CCTGAAGATTTTGCAGTGTATTACTGTCAGCAGTACBHCAGTBHCMTCACTTTTGGCGGAGGGACCAAG | CAGCAGTACBHCAGTBHCMTCACT | 764 | 1380 |
| VK3-20_15_1_8 | CCTGAAGATTTTGCAGTGTATTACTGTCAGCAGTACGGAVNCBHCMTCACTTTTGGCGGAGGGACCAAG | CAGCAGTACGGAVNCBHCMTCACT | 765 | 1381 |
| VK3-20_2_1_8 | CCTGAAGATTTTGCAGTGTATTACTGTSWMCAGBHCGGAAGTAGTMTCACTTTTGGCGGAGGGACCAAG | SWMCAGBHCGGAAGTAGTMTCACT | 766 | 1382 |
| VK3-20_3_1_8 | CCTGAAGATTTTGCAGTGTATTACTGTSWMCAGTACBHCAGTAGTMTCACTTTTGGCGGAGGGACCAAG | SWMCAGTACBHCAGTAGTMTCACT | 767 | 1383 |
| VK3-20_4_1_8 | CCTGAAGATTTTGCAGTGTATTACTGTSWMCAGTACGGAVNCAGTMTCACTTTTGGCGGAGGGACCAAG | SWMCAGTACGGAVNCAGTMTCACT | 768 | 1384 |
| VK3-20_5_1_8 | CCTGAAGATTTTGCAGTGTATTACTGTSWMCAGTACGGAAGTBHCMTCACTTTTGGCGGAGGGACCAAG | SWMCAGTACGGAAGTBHCMTCACT | 769 | 1385 |
| VK3-20_6_1_8 | CCTGAAGATTTTGCAGTGTATTACTGTCAGSWMBHCGGAAGTAGTMTCACTTTTGGCGGAGGGACCAAG | CAGSWMBHCGGAAGTAGTMTCACT | 770 | 1386 |
| VK3-20_7_1_8 | CCTGAAGATTTTGCAGTGTATTACTGTCAGSWMTACBHCAGTAGTMTCACTTTTGGCGGAGGGACCAAG | CAGSWMTACBHCAGTAGTMTCACT | 771 | 1387 |
| VK3-20_8_1_8 | CCTGAAGATTTTGCAGTGTATTACTGTCAGSWMTACGGAVNCAGTMTCACTTTTGGCGGAGGGACCAAG | CAGSWMTACGGAVNCAGTMTCACT | 772 | 1388 |
| VK3-20_9_1_8 | CCTGAAGATTTTGCAGTGTATTACTGTCAGSWMTACGGAAGTBHCMTCACTTTTGGCGGAGGGACCAAG | CAGSWMTACGGAAGTBHCMTCACT | 773 | 1389 |
| VK3-20_1_2_8 | CCTGAAGATTTTGCAGTGTATTACTGTSWMSWMTACGGAAGTAGTWGGACTTTTGGCGGAGGGACCAAG | SWMSWMTACGGAAGTAGTWGGACT | 774 | 1390 |
| VK3-20_10_2_8 | CCTGAAGATTTTGCAGTGTATTACTGTCAGCAGBHCBHCAGTAGTWGGACTTTTGGCGGAGGGACCAAG | CAGCAGBHCBHCAGTAGTWGGACT | 775 | 1391 |
| VK3-20_11_2_8 | CCTGAAGATTTTGCAGTGTATTACTGTCAGCAGBHCGGAVNCAGTWGGACTTTTGGCGGAGGGACCAAG | CAGCAGBHCGGAVNCAGTWGGACT | 776 | 1392 |
| VK3-20_12_2_8 | CCTGAAGATTTTGCAGTGTATTACTGTCAGCAGBHCGGAAGTBHCWGGACTTTTGGCGGAGGGACCAAG | CAGCAGBHCGGAAGTBHCWGGACT | 777 | 1393 |
| VK3-20_13_2_8 | CCTGAAGATTTTGCAGTGTATTACTGTCAGCAGTACBHCVNCAGTWGGACTTTTGGCGGAGGGACCAAG | CAGCAGTACBHCVNCAGTWGGACT | 778 | 1394 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_14_2_8 | CCTGAAGATTTTGCAGTGTATTACTGTCAGCAGTACB HCAGTBHCWGGACTTTTGGCGGAGGGACCAAG | CAGCAGTACBHCAGTBHCWGGACT | 779 | 1395 |
| VK3-20_15_2_8 | CCTGAAGATTTTGCAGTGTATTACTGTCAGCAGTACG GAVNCBHCWGGACTTTTGGCGGAGGGACCAAG | CAGCAGTACGGAVNCBHCWGGACT | 780 | 1396 |
| VK3-20_2_2_8 | CCTGAAGATTTTGCAGTGTATTACTGTSWMCAGBHCG GAAGTAGTWGGACTTTTGGCGGAGGGACCAAG | SWMCAGBHCGGAAGTAGTWGGACT | 781 | 1397 |
| VK3-20_3_2_8 | CCTGAAGATTTTGCAGTGTATTACTGTSWMCAGTACB HCAGTAGTWGGACTTTTGGCGGAGGGACCAAG | SWMCAGTACBHCAGTAGTWGGACT | 782 | 1398 |
| VK3-20_4_2_8 | CCTGAAGATTTTGCAGTGTATTACTGTSWMCAGTACG GAVNCAGTWGGACTTTTGGCGGAGGGACCAAG | SWMCAGTACGGAVNCAGTWGGACT | 783 | 1399 |
| VK3-20_5_2_8 | CCTGAAGATTTTGCAGTGTATTACTGTSWMCAGTACG GAAGTBHCWGGACTTTTGGCGGAGGGACCAAG | SWMCAGTACGGAAGTBHCWGGACT | 784 | 1400 |
| VK3-20_6_2_8 | CCTGAAGATTTTGCAGTGTATTACTGTCAGSWMBHCG GAAGTAGTWGGACTTTTGGCGGAGGGACCAAG | CAGSWMBHCGGAAGTAGTWGGACT | 785 | 1401 |
| VK3-20_7_2_8 | CCTGAAGATTTTGCAGTGTATTACTGTCAGSWMTACB HCAGTAGTWGGACTTTTGGCGGAGGGACCAAG | CAGSWMTACBHCAGTAGTWGGACT | 786 | 1402 |
| VK3-20_8_2_8 | CCTGAAGATTTTGCAGTGTATTACTGTCAGSWMTACG GAVNCAGTWGGACTTTTGGCGGAGGGACCAAG | CAGSWMTACGGAVNCAGTWGGACT | 787 | 1403 |
| VK3-20_9_2_8 | CCTGAAGATTTTGCAGTGTATTACTGTCAGSWMTACG GAAGTBHCWGGACTTTTGGCGGAGGGACCAAG | CAGSWMTACGGAAGTBHCWGGACT | 788 | 1404 |
| VK3-20_1_3_8 | CCTGAAGATTTTGCAGTGTATTACTGTSWMSWMTACG GAAGTAGTCCTACTTTTGGCGGAGGGACCAAG | SWMSWMTACGGAAGTAGTCCTACT | 789 | 1405 |
| VK3-20_10_3_8 | CCTGAAGATTTTGCAGTGTATTACTGTCAGCAGBHCB HCAGTAGTCCTACTTTTGGCGGAGGGACCAAG | CAGCAGBHCBHCAGTAGTCCTACT | 790 | 1406 |
| VK3-20_11_3_8 | CCTGAAGATTTTGCAGTGTATTACTGTCAGCAGBHCG GAVNCAGTCCTACTTTTGGCGGAGGGACCAAG | CAGCAGBHCGGAVNCAGTCCTACT | 791 | 1407 |
| VK3-20_12_3_8 | CCTGAAGATTTTGCAGTGTATTACTGTCAGCAGBHCG GAAGTBHCCCTACTTTTGGCGGAGGGACCAAG | CAGCAGBHCGGAAGTBHCCCTACT | 792 | 1408 |
| VK3-20_13_3_8 | CCTGAAGATTTTGCAGTGTATTACTGTCAGCAGTACB HCVNCAGTCCTACTTTTGGCGGAGGGACCAAG | CAGCAGTACBHCVNCAGTCCTACT | 793 | 1409 |
| VK3-20_14_3_8 | CCTGAAGATTTTGCAGTGTATTACTGTCAGCAGTACB HCAGTBHCCCTACTTTTGGCGGAGGGACCAAG | CAGCAGTACBHCAGTBHCCCTACT | 794 | 1410 |
| VK3-20_15_3_8 | CCTGAAGATTTTGCAGTGTATTACTGTCAGCAGTACG GAVNCBHCCCTACTTTTGGCGGAGGGACCAAG | CAGCAGTACGGAVNCBHCCCTACT | 795 | 1411 |
| VK3-20_2_3_8 | CCTGAAGATTTTGCAGTGTATTACTGTSWMCAGBHCG GAAGTAGTCCTACTTTTGGCGGAGGGACCAAG | SWMCAGBHCGGAAGTAGTCCTACT | 796 | 1412 |
| VK3-20_3_3_8 | CCTGAAGATTTTGCAGTGTATTACTGTSWMCAGTACB HCAGTAGTCCTACTTTTGGCGGAGGGACCAAG | SWMCAGTACBHCAGTAGTCCTACT | 797 | 1413 |
| VK3-20_4_3_8 | CCTGAAGATTTTGCAGTGTATTACTGTSWMCAGTACG GAVNCAGTCCTACTTTTGGCGGAGGGACCAAG | SWMCAGTACGGAVNCAGTCCTACT | 798 | 1414 |
| VK3-20_5_3_8 | CCTGAAGATTTTGCAGTGTATTACTGTSWMCAGTACG GAAGTBHCCCTACTTTTGGCGGAGGGACCAAG | SWMCAGTACGGAAGTBHCCCTACT | 799 | 1415 |
| VK3-20_6_3_8 | CCTGAAGATTTTGCAGTGTATTACTGTCAGSWMBHCG GAAGTAGTCCTACTTTTGGCGGAGGGACCAAG | CAGSWMBHCGGAAGTAGTCCTACT | 800 | 1416 |
| VK3-20_7_3_8 | CCTGAAGATTTTGCAGTGTATTACTGTCAGSWMTACB HCAGTAGTCCTACTTTTGGCGGAGGGACCAAG | CAGSWMTACBHCAGTAGTCCTACT | 801 | 1417 |
| VK3-20_8_3_8 | CCTGAAGATTTTGCAGTGTATTACTGTCAGSWMTACG GAVNCAGTCCTACTTTTGGCGGAGGGACCAAG | CAGSWMTACGGAVNCAGTCCTACT | 802 | 1418 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_9_3_8 | CCTGAAGATTTTGCAGTGTATTACTGTCAGSWMTACG GAAGTBHCCCTACTTTTGGCGGAGGGACCAAG | CAGSWMTACGGAAGTBHCCCTACT | 803 | 1419 |

Jumping Trimer

| VK1-05_t1_0_8 | CCTGATGATTTTGCAACTTATTACTGCCAGCAGBHCV RMMBCTACTWCACTTTTGGCGGAGGGACCAAG | CAGCAGBHCVRMMBCTACTWCACT | 804 | 1420 |
| VK1-05_t1_1_8 | CCTGATGATTTTGCAACTTATTACTGCCAGCAGBHCV RMMBCTACMTCACTTTTGGCGGAGGGACCAAG | CAGCAGBHCVRMMBCTACMTCACT | 805 | 1421 |
| VK1-05_t1_2_8 | CCTGATGATTTTGCAACTTATTACTGCCAGCAGBHCV RMMBCTACWGGACTTTTGGCGGAGGGACCAAG | CAGCAGBHCVRMMBCTACWGGACT | 806 | 1422 |
| VK1-05_t1_3_8 | CCTGATGATTTTGCAACTTATTACTGCCAGCAGBHCV RMMBCTACYCTACTTTTGGCGGAGGGACCAAG | CAGCAGBHCVRMMBCTACYCTACT | 807 | 1423 |
| VK1-05_t2_0_8 | CCTGATGATTTTGCAACTTATTACTGCCAGCAGBHCA ATMBCYWCTWCACTTTTGGCGGAGGGACCAAG | CAGCAGBHCAATMBCYWCTWCACT | 808 | 1424 |
| VK1-05_t2_1_8 | CCTGATGATTTTGCAACTTATTACTGCCAGCAGBHCA ATMBCYWCMTCACTTTTGGCGGAGGGACCAAG | CAGCAGBHCAATMBCYWCMTCACT | 809 | 1425 |
| VK1-05_t2_2_8 | CCTGATGATTTTGCAACTTATTACTGCCAGCAGBHCA ATMBCYWCWGGACTTTTGGCGGAGGGACCAAG | CAGCAGBHCAATMBCYWCWGGACT | 810 | 1426 |
| VK1-05_t2_3_8 | CCTGATGATTTTGCAACTTATTACTGCCAGCAGBHCA ATMBCYWCYCTACTTTTGGCGGAGGGACCAAG | CAGCAGBHCAATMBCYWCYCTACT | 811 | 1427 |
| VK1-05_t3_0_8 | CCTGATGATTTTGCAACTTATTACTGCCAGCAGBHCV RMAGTYWCTWCACTTTTGGCGGAGGGACCAAG | CAGCAGBHCVRMAGTYWCTWCACT | 812 | 1428 |
| VK1-05_t3_1_8 | CCTGATGATTTTGCAACTTATTACTGCCAGCAGBHCV RMAGTYWCMTCACTTTTGGCGGAGGGACCAAG | CAGCAGBHCVRMAGTYWCMTCACT | 813 | 1429 |
| VK1-05_t3_2_8 | CCTGATGATTTTGCAACTTATTACTGCCAGCAGBHCV RMAGTYWCWGGACTTTTGGCGGAGGGACCAAG | CAGCAGBHCVRMAGTYWCWGGACT | 814 | 1430 |
| VK1-05_t3_3_8 | CCTGATGATTTTGCAACTTATTACTGCCAGCAGBHCV RMAGTYWCYCTACTTTTGGCGGAGGGACCAAG | CAGCAGBHCVRMAGTYWCYCTACT | 815 | 1431 |
| VK1-05_t4_0_8 | CCTGATGATTTTGCAACTTATTACTGCCAGCAGTACV RMMBCYWCTWCACTTTTGGCGGAGGGACCAAG | CAGCAGTACVRMMBCYWCTWCACT | 816 | 1432 |
| VK1-05_t4_1_8 | CCTGATGATTTTGCAACTTATTACTGCCAGCAGTACV RMMBCYWCMTCACTTTTGGCGGAGGGACCAAG | CAGCAGTACVRMMBCYWCMTCACT | 817 | 1433 |
| VK1-05_t4_2_8 | CCTGATGATTTTGCAACTTATTACTGCCAGCAGTACV RMMBCYWCWGGACTTTTGGCGGAGGGACCAAG | CAGCAGTACVRMMBCYWCWGGACT | 818 | 1434 |
| VK1-05_t4_3_8 | CCTGATGATTTTGCAACTTATTACTGCCAGCAGTACV RMMBCYWCYCTACTTTTGGCGGAGGGACCAAG | CAGCAGTACVRMMBCYWCYCTACT | 819 | 1435 |
| VK1-12_t1_0_8 | CCTGAAGATTTTGCAACTTATTACTGTCAGCAGRNAN HCNHCTTCTWCACTTTTGGCGGAGGGACCAAG | CAGCAGRNANHCNHCTTCTWCACT | 820 | 1436 |
| VK1-12_t1_1_8 | CCTGAAGATTTTGCAACTTATTACTGTCAGCAGRNAN HCNHCTTCMTCACTTTTGGCGGAGGGACCAAG | CAGCAGRNANHCNHCTTCMTCACT | 821 | 1437 |
| VK1-12_t1_2_8 | CCTGAAGATTTTGCAACTTATTACTGTCAGCAGRNAN HCNHCTTCWGGACTTTTGGCGGAGGGACCAAG | CAGCAGRNANHCNHCTTCWGGACT | 822 | 1438 |
| VK1-12_t1_3_8 | CCTGAAGATTTTGCAACTTATTACTGTCAGCAGRNAN HCNHCTTCCCTACTTTTGGCGGAGGGACCAAG | CAGCAGRNANHCNHCTTCCCTACT | 823 | 1439 |
| VK1-12_t2_0_8 | CCTGAAGATTTTGCAACTTATTACTGTCAGCAGRNAN HCAGTYWCTWCACTTTTGGCGGAGGGACCAAG | CAGCAGRNANHCAGTYWCTWCACT | 824 | 1440 |
| VK1-12_t2_1_8 | CCTGAAGATTTTGCAACTTATTACTGTCAGCAGRNAN HCAGTYWCMTCACTTTTGGCGGAGGGACCAAG | CAGCAGRNANHCAGTYWCMTCACT | 825 | 1441 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_t2_2_8 | CCTGAAGATTTTGCAACTTATTACTGTCAGCAGRNANHCAGTYWCWGGACTTTTGGCGGAGGGACCAAG | CAGCAGRNANHCAGTYWCWGGACT | 826 | 1442 |
| VK1-12_t2_3_8 | CCTGAAGATTTTGCAACTTATTACTGTCAGCAGRNANHCAGTYWCCCTACTTTTGGCGGAGGGACCAAG | CAGCAGRNANHCAGTYWCCCTACT | 827 | 1443 |
| VK1-12_t3_0_8 | CCTGAAGATTTTGCAACTTATTACTGTCAGCAGRNAAATNHCYWCTWCACTTTTGGCGGAGGGACCAAG | CAGCAGRNAAATNHCYWCTWCACT | 828 | 1444 |
| VK1-12_t3_1_8 | CCTGAAGATTTTGCAACTTATTACTGTCAGCAGRNAAATNHCYWCMTCACTTTTGGCGGAGGGACCAAG | CAGCAGRNAAATNHCYWCMTCACT | 829 | 1445 |
| VK1-12_t3_2_8 | CCTGAAGATTTTGCAACTTATTACTGTCAGCAGRNAAATNHCYWCWGGACTTTTGGCGGAGGGACCAAG | CAGCAGRNAAATNHCYWCWGGACT | 830 | 1446 |
| VK1-12_t3_3_8 | CCTGAAGATTTTGCAACTTATTACTGTCAGCAGRNAAATNHCYWCCCTACTTTTGGCGGAGGGACCAAG | CAGCAGRNAAATNHCYWCCCTACT | 831 | 1447 |
| VK1-12_t4_0_8 | CCTGAAGATTTTGCAACTTATTACTGTCAGCAGGCANHCNHCYWCTWCACTTTTGGCGGAGGGACCAAG | CAGCAGGCANHCNHCYWCTWCACT | 832 | 1448 |
| VK1-12_t4_1_8 | CCTGAAGATTTTGCAACTTATTACTGTCAGCAGGCANHCNHCYWCMTCACTTTTGGCGGAGGGACCAAG | CAGCAGGCANHCNHCYWCMTCACT | 833 | 1449 |
| VK1-12_t4_2_8 | CCTGAAGATTTTGCAACTTATTACTGTCAGCAGGCANHCNHCYWCWGGACTTTTGGCGGAGGGACCAAG | CAGCAGGCANHCNHCYWCWGGACT | 834 | 1450 |
| VK1-12_t4_3_8 | CCTGAAGATTTTGCAACTTATTACTGTCAGCAGGCANHCNHCYWCCCTACTTTTGGCGGAGGGACCAAG | CAGCAGGCANHCNHCYWCCCTACT | 835 | 1451 |
| VK1-33_t1_0_8 | CCTGAAGATATTGCAACATATTACTGTCAGCAGBHCNHCNHCCTCTWCACTTTTGGCGGAGGGACCAAG | CAGCAGBHCNHCNHCCTCTWCACT | 836 | 1452 |
| VK1-33_t1_1_8 | CCTGAAGATATTGCAACATATTACTGTCAGCAGBHCNHCNHCCTCMTCACTTTTGGCGGAGGGACCAAG | CAGCAGBHCNHCNHCCTCMTCACT | 837 | 1453 |
| VK1-33_t1_2_8 | CCTGAAGATATTGCAACATATTACTGTCAGCAGBHCNHCNHCCTCWGGACTTTTGGCGGAGGGACCAAG | CAGCAGBHCNHCNHCCTCWGGACT | 838 | 1454 |
| VK1-33_t1_3_8 | CCTGAAGATATTGCAACATATTACTGTCAGCAGBHCNHCNHCCTCCCTACTTTTGGCGGAGGGACCAAG | CAGCAGBHCNHCNHCCTCCCTACT | 839 | 1455 |
| VK1-33_t2_0_8 | CCTGAAGATATTGCAACATATTACTGTCAGCAGBHCNHCAATYWCTWCACTTTTGGCGGAGGGACCAAG | CAGCAGBHCNHCAATYWCTWCACT | 840 | 1456 |
| VK1-33_t2_1_8 | CCTGAAGATATTGCAACATATTACTGTCAGCAGBHCNHCAATYWCMTCACTTTTGGCGGAGGGACCAAG | CAGCAGBHCNHCAATYWCMTCACT | 841 | 1457 |
| VK1-33_t2_2_8 | CCTGAAGATATTGCAACATATTACTGTCAGCAGBHCNHCAATYWCWGGACTTTTGGCGGAGGGACCAAG | CAGCAGBHCNHCAATYWCWGGACT | 842 | 1458 |
| VK1-33_t2_3_8 | CCTGAAGATATTGCAACATATTACTGTCAGCAGBHCNHCAATYWCCCTACTTTTGGCGGAGGGACCAAG | CAGCAGBHCNHCAATYWCCCTACT | 843 | 1459 |
| VK1-33_t3_0_8 | CCTGAAGATATTGCAACATATTACTGTCAGCAGBHCGATNHCYWCTWCACTTTTGGCGGAGGGACCAAG | CAGCAGBHCGATNHCYWCTWCACT | 844 | 1460 |
| VK1-33_t3_1_8 | CCTGAAGATATTGCAACATATTACTGTCAGCAGBHCGATNHCYWCMTCACTTTTGGCGGAGGGACCAAG | CAGCAGBHCGATNHCYWCMTCACT | 845 | 1461 |
| VK1-33_t3_2_8 | CCTGAAGATATTGCAACATATTACTGTCAGCAGBHCGATNHCYWCWGGACTTTTGGCGGAGGGACCAAG | CAGCAGBHCGATNHCYWCWGGACT | 846 | 1462 |
| VK1-33_t3_3_8 | CCTGAAGATATTGCAACATATTACTGTCAGCAGBHCGATNHCYWCCCTACTTTTGGCGGAGGGACCAAG | CAGCAGBHCGATNHCYWCCCTACT | 847 | 1463 |
| VK1-33_t4_0_8 | CCTGAAGATATTGCAACATATTACTGTCAGCAGTACNHCNHCYWCTWCACTTTTGGCGGAGGGACCAAG | CAGCAGTACNHCNHCYWCTWCACT | 848 | 1464 |
| VK1-33_t4_1_8 | CCTGAAGATATTGCAACATATTACTGTCAGCAGTACNHCNHCYWCMTCACTTTTGGCGGAGGGACCAAG | CAGCAGTACNHCNHCYWCMTCACT | 849 | 1465 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_t4_2_8 | CCTGAAGATATTGCAACATATTACTGTCAGCAGTACNHCNHCYWCWGGACTTTTGGCGGAGGGACCAAG | CAGCAGTACNHCNHCYWCWGGACT | 850 | 1466 |
| VK1-33_t4_3_8 | CCTGAAGATATTGCAACATATTACTGTCAGCAGTACNHCNHCYWCCCTACTTTTGGCGGAGGGACCAAG | CAGCAGTACNHCNHCYWCCCTACT | 851 | 1467 |
| VK1-39_t1_0_8 | CCTGAAGATTTTGCAACTTACTACTGTCAGCAAVNABHCNHCACTTWCACTTTTGGCGGAGGGACCAAG | CAGCAAVNABHCNHCACTTWCACT | 852 | 1468 |
| VK1-39_t1_1_8 | CCTGAAGATTTTGCAACTTACTACTGTCAGCAAVNABHCNHCACTMTCACTTTTGGCGGAGGGACCAAG | CAGCAAVNABHCNHCACTMTCACT | 853 | 1469 |
| VK1-39_t1_2_8 | CCTGAAGATTTTGCAACTTACTACTGTCAGCAAVNABHCNHCACTWGGACTTTTGGCGGAGGGACCAAG | CAGCAAVNABHCNHCACTWGGACT | 854 | 1470 |
| VK1-39_t1_3_8 | CCTGAAGATTTTGCAACTTACTACTGTCAGCAAVNABHCNHCACTCCTACTTTTGGCGGAGGGACCAAG | CAGCAAVNABHCNHCACTCCTACT | 855 | 1471 |
| VK1-39_t2_0_8 | CCTGAAGATTTTGCAACTTACTACTGTCAGCAAVNABHCAGTBHCTWCACTTTTGGCGGAGGGACCAAG | CAGCAAVNABHCAGTBHCTWCACT | 856 | 1472 |
| VK1-39_t2_1_8 | CCTGAAGATTTTGCAACTTACTACTGTCAGCAAVNABHCAGTBHCMTCACTTTTGGCGGAGGGACCAAG | CAGCAAVNABHCAGTBHCMTCACT | 857 | 1473 |
| VK1-39_t2_2_8 | CCTGAAGATTTTGCAACTTACTACTGTCAGCAAVNABHCAGTBHCWGGACTTTTGGCGGAGGGACCAAG | CAGCAAVNABHCAGTBHCWGGACT | 858 | 1474 |
| VK1-39_t2_3_8 | CCTGAAGATTTTGCAACTTACTACTGTCAGCAAVNABHCAGTBHCCCTACTTTTGGCGGAGGGACCAAG | CAGCAAVNABHCAGTBHCCCTACT | 859 | 1475 |
| VK1-39_t3_0_8 | CCTGAAGATTTTGCAACTTACTACTGTCAGCAAVNATACNHCBHCTWCACTTTTGGCGGAGGGACCAAG | CAGCAAVNATACNHCBHCTWCACT | 860 | 1476 |
| VK1-39_t3_1_8 | CCTGAAGATTTTGCAACTTACTACTGTCAGCAAVNATACNHCBHCMTCACTTTTGGCGGAGGGACCAAG | CAGCAAVNATACNHCBHCMTCACT | 861 | 1477 |
| VK1-39_t3_2_8 | CCTGAAGATTTTGCAACTTACTACTGTCAGCAAVNATACNHCBHCWGGACTTTTGGCGGAGGGACCAAG | CAGCAAVNATACNHCBHCWGGACT | 862 | 1478 |
| VK1-39_t3_3_8 | CCTGAAGATTTTGCAACTTACTACTGTCAGCAAVNATACNHCBHCCCTACTTTTGGCGGAGGGACCAAG | CAGCAAVNATACNHCBHCCCTACT | 863 | 1479 |
| VK1-39_t4_0_8 | CCTGAAGATTTTGCAACTTACTACTGTCAGCAAAGCBHCNHCBHCTWCACTTTTGGCGGAGGGACCAAG | CAGCAAAGCBHCNHCBHCTWCACT | 864 | 1480 |
| VK1-39_t4_1_8 | CCTGAAGATTTTGCAACTTACTACTGTCAGCAAAGCBHCNHCBHCMTCACTTTTGGCGGAGGGACCAAG | CAGCAAAGCBHCNHCBHCMTCACT | 865 | 1481 |
| VK1-39_t4_2_8 | CCTGAAGATTTTGCAACTTACTACTGTCAGCAAAGCBHCNHCBHCWGGACTTTTGGCGGAGGGACCAAG | CAGCAAAGCBHCNHCBHCWGGACT | 866 | 1482 |
| VK1-39_t4_3_8 | CCTGAAGATTTTGCAACTTACTACTGTCAGCAAAGCBHCNHCBHCCCTACTTTTGGCGGAGGGACCAAG | CAGCAAAGCBHCNHCBHCCCTACT | 867 | 1483 |
| VK2-28_t1_0_8 | GCTGAGGATGTTGGGGTTTATTACTGCATGCAGVNAMNASRMACTTWCACTTTTGGCGGAGGGACCAAG | ATGCAGVNAMNASRMACTTWCACT | 868 | 1484 |
| VK2-28_t1_1_8 | GCTGAGGATGTTGGGGTTTATTACTGCATGCAGVNAMNASRMACTMTCACTTTTGGCGGAGGGACCAAG | ATGCAGVNAMNASRMACTMTCACT | 869 | 1485 |
| VK2-28_t1_2_8 | GCTGAGGATGTTGGGGTTTATTACTGCATGCAGVNAMNASRMACTWGGACTTTTGGCGGAGGGACCAAG | ATGCAGVNAMNASRMACTWGGACT | 870 | 1486 |
| VK2-28_t1_3_8 | GCTGAGGATGTTGGGGTTTATTACTGCATGCAGVNAMNASRMACTCCTACTTTTGGCGGAGGGACCAAG | ATGCAGVNAMNASRMACTCCTACT | 871 | 1487 |
| VK2-28_t2_0_8 | GCTGAGGATGTTGGGGTTTATTACTGCATGCAGVNAMNACAGVBCTWCACTTTTGGCGGAGGGACCAAG | ATGCAGVNAMNACAGVBCTWCACT | 872 | 1488 |
| VK2-28_t2_1_8 | GCTGAGGATGTTGGGGTTTATTACTGCATGCAGVNAMNACAGVBCMTCACTTTTGGCGGAGGGACCAAG | ATGCAGVNAMNACAGVBCMTCACT | 873 | 1489 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_t2_2_8 | GCTGAGGATGTTGGGGTTTATTACTGCATGCAGVNAMNACAGVBCWGGACTTTTGGCGGAGGGACCAAG | ATGCAGVNAMNACAGVBCWGGACT | 874 | 1490 |
| VK2-28_t2_3_8 | GCTGAGGATGTTGGGGTTTATTACTGCATGCAGVNAMNACAGVBCCCTACTTTTGGCGGAGGGACCAAG | ATGCAGVNAMNACAGVBCCCTACT | 875 | 1491 |
| VK2-28_t3_0_8 | GCTGAGGATGTTGGGGTTTATTACTGCATGCAGVNACTCSRMVBCTWCACTTTTGGCGGAGGGACCAAG | ATGCAGVNACTCSRMVBCTWCACT | 876 | 1492 |
| VK2-28_t3_1_8 | GCTGAGGATGTTGGGGTTTATTACTGCATGCAGVNACTCSRMVBCMTCACTTTTGGCGGAGGGACCAAG | ATGCAGVNACTCSRMVBCMTCACT | 877 | 1493 |
| VK2-28_t3_2_8 | GCTGAGGATGTTGGGGTTTATTACTGCATGCAGVNACTCSRMVBCWGGACTTTTGGCGGAGGGACCAAG | ATGCAGVNACTCSRMVBCWGGACT | 878 | 1494 |
| VK2-28_t3_3_8 | GCTGAGGATGTTGGGGTTTATTACTGCATGCAGVNACTCSRMVBCCCTACTTTTGGCGGAGGGACCAAG | ATGCAGVNACTCSRMVBCCCTACT | 879 | 1495 |
| VK2-28_t4_0_8 | GCTGAGGATGTTGGGGTTTATTACTGCATGCAGGCAMNASRMVBCTWCACTTTTGGCGGAGGGACCAAG | ATGCAGGCAMNASRMVBCTWCACT | 880 | 1496 |
| VK2-28_t4_1_8 | GCTGAGGATGTTGGGGTTTATTACTGCATGCAGGCAMNASRMVBCMTCACTTTTGGCGGAGGGACCAAG | ATGCAGGCAMNASRMVBCMTCACT | 881 | 1497 |
| VK2-28_t4_2_8 | GCTGAGGATGTTGGGGTTTATTACTGCATGCAGGCAMNASRMVBCWGGACTTTTGGCGGAGGGACCAAG | ATGCAGGCAMNASRMVBCWGGACT | 882 | 1498 |
| VK2-28_t4_3_8 | GCTGAGGATGTTGGGGTTTATTACTGCATGCAGGCAMNASRMVBCCCTACTTTTGGCGGAGGGACCAAG | ATGCAGGCAMNASRMVBCCCTACT | 883 | 1499 |
| VK3-11_t1_0_8 | CCTGAAGATTTTGCAGTTTATTACTGTCAGCAGBHCNHCNHCTGGTWCACTTTTGGCGGAGGGACCAAG | CAGCAGBHCNHCNHCTGGTWCACT | 884 | 1500 |
| VK3-11_t1_1_8 | CCTGAAGATTTTGCAGTTTATTACTGTCAGCAGBHCNHCNHCTGGMTCACTTTTGGCGGAGGGACCAAG | CAGCAGBHCNHCNHCTGGMTCACT | 885 | 1501 |
| VK3-11_t1_2_8 | CCTGAAGATTTTGCAGTTTATTACTGTCAGCAGBHCNHCNHCTGGWGGACTTTTGGCGGAGGGACCAAG | CAGCAGBHCNHCNHCTGGWGGACT | 886 | 1502 |
| VK3-11_t1_3_8 | CCTGAAGATTTTGCAGTTTATTACTGTCAGCAGBHCNHCNHCTGGCCTACTTTTGGCGGAGGGACCAAG | CAGCAGBHCNHCNHCTGGCCTACT | 887 | 1503 |
| VK3-11_t2_0_8 | CCTGAAGATTTTGCAGTTTATTACTGTCAGCAGBHCNHCAATYWCTWCACTTTTGGCGGAGGGACCAAG | CAGCAGBHCNHCAATYWCTWCACT | 888 | 1456 |
| VK3-11_t2_1_8 | CCTGAAGATTTTGCAGTTTATTACTGTCAGCAGBHCNHCAATYWCMTCACTTTTGGCGGAGGGACCAAG | CAGCAGBHCNHCAATYWCMTCACT | 889 | 1457 |
| VK3-11_t2_2_8 | CCTGAAGATTTTGCAGTTTATTACTGTCAGCAGBHCNHCAATYWCWGGACTTTTGGCGGAGGGACCAAG | CAGCAGBHCNHCAATYWCWGGACT | 890 | 1458 |
| VK3-11_t2_3_8 | CCTGAAGATTTTGCAGTTTATTACTGTCAGCAGBHCNHCAATYWCCCTACTTTTGGCGGAGGGACCAAG | CAGCAGBHCNHCAATYWCCCTACT | 891 | 1459 |
| VK3-11_t3_0_8 | CCTGAAGATTTTGCAGTTTATTACTGTCAGCAGBHCAGTNHCYWCTWCACTTTTGGCGGAGGGACCAAG | CAGCAGBHCAGTNHCYWCTWCACT | 892 | 1504 |
| VK3-11_t3_1_8 | CCTGAAGATTTTGCAGTTTATTACTGTCAGCAGBHCAGTNHCYWCMTCACTTTTGGCGGAGGGACCAAG | CAGCAGBHCAGTNHCYWCMTCACT | 893 | 1505 |
| VK3-11_t3_2_8 | CCTGAAGATTTTGCAGTTTATTACTGTCAGCAGBHCAGTNHCYWCWGGACTTTTGGCGGAGGGACCAAG | CAGCAGBHCAGTNHCYWCWGGACT | 894 | 1506 |
| VK3-11_t3_3_8 | CCTGAAGATTTTGCAGTTTATTACTGTCAGCAGBHCAGTNHCYWCCCTACTTTTGGCGGAGGGACCAAG | CAGCAGBHCAGTNHCYWCCCTACT | 895 | 1507 |
| VK3-11_t4_0_8 | CCTGAAGATTTTGCAGTTTATTACTGTCAGCAGAGANHCNHCYWCTWCACTTTTGGCGGAGGGACCAAG | CAGCAGAGANHCNHCYWCTWCACT | 896 | 1508 |
| VK3-11_t4_1_8 | CCTGAAGATTTTGCAGTTTATTACTGTCAGCAGAGANHCNHCYWCMTCACTTTTGGCGGAGGGACCAAG | CAGCAGAGANHCNHCYWCMTCACT | 897 | 1509 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK3-11_t4_2_8 | CCTGAAGATTTTGCAGTTTATTACTGTCAGCAGAGANHCNHCYWCWGGACTTTTGGCGGAGGGACCAAG | CAGCAGAGANHCNHCYWCWGGACT | 898 | 1510 |
| VK3-11_t4_3_8 | CCTGAAGATTTTGCAGTTTATTACTGTCAGCAGAGANHCNHCYWCCCTACTTTTGGCGGAGGGACCAAG | CAGCAGAGANHCNHCYWCCCTACT | 899 | 1511 |
| VK3-15_t1_0_8 | CAGTCTGAAGATTTTGCAGTTTATTACTGTCAGCAGBHCNHCNHCTGGTWCACTTTTGGCGGAGGGACCAAG | CAGCAGBHCNHCNHCTGGTWCACT | 900 | 1500 |
| VK3-15_t1_1_8 | CAGTCTGAAGATTTTGCAGTTTATTACTGTCAGCAGBHCNHCNHCTGGMTCACTTTTGGCGGAGGGACCAAG | CAGCAGBHCNHCNHCTGGMTCACT | 901 | 1501 |
| VK3-15_t1_2_8 | CAGTCTGAAGATTTTGCAGTTTATTACTGTCAGCAGBHCNHCNHCTGGWGGACTTTTGGCGGAGGGACCAAG | CAGCAGBHCNHCNHCTGGWGGACT | 902 | 1502 |
| VK3-15_t1_3_8 | CAGTCTGAAGATTTTGCAGTTTATTACTGTCAGCAGBHCNHCNHCTGGCCTACTTTTGGCGGAGGGACCAAG | CAGCAGBHCNHCNHCTGGCCTACT | 903 | 1503 |
| VK3-15_t2_0_8 | CAGTCTGAAGATTTTGCAGTTTATTACTGTCAGCAGBHCNHCAATYWCTWCACTTTTGGCGGAGGGACCAAG | CAGCAGBHCNHCAATYWCTWCACT | 904 | 1456 |
| VK3-15_t2_1_8 | CAGTCTGAAGATTTTGCAGTTTATTACTGTCAGCAGBHCNHCAATYWCMTCACTTTTGGCGGAGGGACCAAG | CAGCAGBHCNHCAATYWCMTCACT | 905 | 1457 |
| VK3-15_t2_2_8 | CAGTCTGAAGATTTTGCAGTTTATTACTGTCAGCAGBHCNHCAATYWCWGGACTTTTGGCGGAGGGACCAAG | CAGCAGBHCNHCAATYWCWGGACT | 906 | 1458 |
| VK3-15_t2_3_8 | CAGTCTGAAGATTTTGCAGTTTATTACTGTCAGCAGBHCNHCAATYWCCCTACTTTTGGCGGAGGGACCAAG | CAGCAGBHCNHCAATYWCCCTACT | 907 | 1459 |
| VK3-15_t3_0_8 | CAGTCTGAAGATTTTGCAGTTTATTACTGTCAGCAGBHCAATNHCYWCTWCACTTTTGGCGGAGGGACCAAG | CAGCAGBHCAATNHCYWCTWCACT | 908 | 1512 |
| VK3-15_t3_1_8 | CAGTCTGAAGATTTTGCAGTTTATTACTGTCAGCAGBHCAATNHCYWCMTCACTTTTGGCGGAGGGACCAAG | CAGCAGBHCAATNHCYWCMTCACT | 909 | 1513 |
| VK3-15_t3_2_8 | CAGTCTGAAGATTTTGCAGTTTATTACTGTCAGCAGBHCAATNHCYWCWGGACTTTTGGCGGAGGGACCAAG | CAGCAGBHCAATNHCYWCWGGACT | 910 | 1514 |
| VK3-15_t3_3_8 | CAGTCTGAAGATTTTGCAGTTTATTACTGTCAGCAGBHCAATNHCYWCCCTACTTTTGGCGGAGGGACCAAG | CAGCAGBHCAATNHCYWCCCTACT | 911 | 1515 |
| VK3-15_t4_0_8 | CAGTCTGAAGATTTTGCAGTTTATTACTGTCAGCAGTACNHCNHCYWCTWCACTTTTGGCGGAGGGACCAAG | CAGCAGTACNHCNHCYWCTWCACT | 912 | 1464 |
| VK3-15_t4_1_8 | CAGTCTGAAGATTTTGCAGTTTATTACTGTCAGCAGTACNHCNHCYWCMTCACTTTTGGCGGAGGGACCAAG | CAGCAGTACNHCNHCYWCMTCACT | 913 | 1465 |
| VK3-15_t4_2_8 | CAGTCTGAAGATTTTGCAGTTTATTACTGTCAGCAGTACNHCNHCYWCWGGACTTTTGGCGGAGGGACCAAG | CAGCAGTACNHCNHCYWCWGGACT | 914 | 1466 |
| VK3-15_t4_3_8 | CAGTCTGAAGATTTTGCAGTTTATTACTGTCAGCAGTACNHCNHCYWCCCTACTTTTGGCGGAGGGACCAAG | CAGCAGTACNHCNHCYWCCCTACT | 915 | 1467 |
| VK3-20_t1_0_8 | CCTGAAGATTTTGCAGTGTATTACTGTCAGCAGBHCBHCVNCAGTTWCACTTTTGGCGGAGGGACCAAG | CAGCAGBHCBHCVNCAGTTWCACT | 916 | 1516 |
| VK3-20_t1_1_8 | CCTGAAGATTTTGCAGTGTATTACTGTCAGCAGBHCBHCVNCAGTMTCACTTTTGGCGGAGGGACCAAG | CAGCAGBHCBHCVNCAGTMTCACT | 917 | 1517 |
| VK3-20_t1_2_8 | CCTGAAGATTTTGCAGTGTATTACTGTCAGCAGBHCBHCVNCAGTWGGACTTTTGGCGGAGGGACCAAG | CAGCAGBHCBHCVNCAGTWGGACT | 918 | 1518 |
| VK3-20_t1_3_8 | CCTGAAGATTTTGCAGTGTATTACTGTCAGCAGBHCBHCVNCAGTCCTACTTTTGGCGGAGGGACCAAG | CAGCAGBHCBHCVNCAGTCCTACT | 919 | 1519 |
| VK3-20_t2_0_8 | CCTGAAGATTTTGCAGTGTATTACTGTCAGCAGBHCBHCAGTBHCTWCACTTTTGGCGGAGGGACCAAG | CAGCAGBHCBHCAGTBHCTWCACT | 920 | 1520 |
| VK3-20_t2_1_8 | CCTGAAGATTTTGCAGTGTATTACTGTCAGCAGBHCBHCAGTBHCMTCACTTTTGGCGGAGGGACCAAG | CAGCAGBHCBHCAGTBHCMTCACT | 921 | 1521 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_t2_2_8 | CCTGAAGATTTTGCAGTGTATTACTGTCAGCAGBHCB HCAGTBHCWGGACTTTTGGCGGAGGGACCAAG | CAGCAGBHCBHCAGTBHCWGGACT | 922 | 1522 |
| VK3-20_t2_3_8 | CCTGAAGATTTTGCAGTGTATTACTGTCAGCAGBHCB HCAGTBHCCCTACTTTTGGCGGAGGGACCAAG | CAGCAGBHCBHCAGTBHCCCTACT | 923 | 1523 |
| VK3-20_t3_0_8 | CCTGAAGATTTTGCAGTGTATTACTGTCAGCAGBHCG GAVNCBHCTWCACTTTTGGCGGAGGGACCAAG | CAGCAGBHCGGAVNCBHCTWCACT | 924 | 1524 |
| VK3-20_t3_1_8 | CCTGAAGATTTTGCAGTGTATTACTGTCAGCAGBHCG GAVNCBHCMTCACTTTTGGCGGAGGGACCAAG | CAGCAGBHCGGAVNCBHCMTCACT | 925 | 1525 |
| VK3-20_t3_2_8 | CCTGAAGATTTTGCAGTGTATTACTGTCAGCAGBHCG GAVNCBHCWGGACTTTTGGCGGAGGGACCAAG | CAGCAGBHCGGAVNCBHCWGGACT | 926 | 1526 |
| VK3-20_t3_3_8 | CCTGAAGATTTTGCAGTGTATTACTGTCAGCAGBHCG GAVNCBHCCCTACTTTTGGCGGAGGGACCAAG | CAGCAGBHCGGAVNCBHCCCTACT | 927 | 1527 |
| VK3-20_t4_0_8 | CCTGAAGATTTTGCAGTGTATTACTGTCAGCAGTACB HCVNCBHCTWCACTTTTGGCGGAGGGACCAAG | CAGCAGTACBHCVNCBHCTWCACT | 928 | 1528 |
| VK3-20_t4_1_8 | CCTGAAGATTTTGCAGTGTATTACTGTCAGCAGTACB HCVNCBHCMTCACTTTTGGCGGAGGGACCAAG | CAGCAGTACBHCVNCBHCMTCACT | 929 | 1529 |
| VK3-20_t4_2_8 | CCTGAAGATTTTGCAGTGTATTACTGTCAGCAGTACB HCVNCBHCWGGACTTTTGGCGGAGGGACCAAG | CAGCAGTACBHCVNCBHCWGGACT | 930 | 1530 |
| VK3-20_t4_3_8 | CCTGAAGATTTTGCAGTGTATTACTGTCAGCAGTACB HCVNCBHCCCTACTTTTGGCGGAGGGACCAAG | CAGCAGTACBHCVNCBHCCCTACT | 931 | 1531 |
| VK4-01_t1_0_8 | GCTGAAGATGTGGCAGTTTATTACTGTCAGCAGBHCB HCNHCACTTWCACTTTTGGCGGAGGGACCAAG | CAGCAGBHCBHCNHCACTTWCACT | 932 | 1532 |
| VK4-01_t1_1_8 | GCTGAAGATGTGGCAGTTTATTACTGTCAGCAGBHCB HCNHCACTMTCACTTTTGGCGGAGGGACCAAG | CAGCAGBHCBHCNHCACTMTCACT | 933 | 1533 |
| VK4-01_t1_2_8 | GCTGAAGATGTGGCAGTTTATTACTGTCAGCAGBHCB HCNHCACTWGGACTTTTGGCGGAGGGACCAAG | CAGCAGBHCBHCNHCACTWGGACT | 934 | 1534 |
| VK4-01_t1_3_8 | GCTGAAGATGTGGCAGTTTATTACTGTCAGCAGBHCB HCNHCACTCCTACTTTTGGCGGAGGGACCAAG | CAGCAGBHCBHCNHCACTCCTACT | 935 | 1535 |
| VK4-01_t2_0_8 | GCTGAAGATGTGGCAGTTTATTACTGTCAGCAGBHCB HCAGTBHCTWCACTTTTGGCGGAGGGACCAAG | CAGCAGBHCBHCAGTBHCTWCACT | 936 | 1520 |
| VK4-01_t2_1_8 | GCTGAAGATGTGGCAGTTTATTACTGTCAGCAGBHCB HCAGTBHCMTCACTTTTGGCGGAGGGACCAAG | CAGCAGBHCBHCAGTBHCMTCACT | 937 | 1521 |
| VK4-01_t2_2_8 | GCTGAAGATGTGGCAGTTTATTACTGTCAGCAGBHCB HCAGTBHCWGGACTTTTGGCGGAGGGACCAAG | CAGCAGBHCBHCAGTBHCWGGACT | 938 | 1522 |
| VK4-01_t2_3_8 | GCTGAAGATGTGGCAGTTTATTACTGTCAGCAGBHCB HCAGTBHCCCTACTTTTGGCGGAGGGACCAAG | CAGCAGBHCBHCAGTBHCCCTACT | 939 | 1523 |
| VK4-01_t3_0_8 | GCTGAAGATGTGGCAGTTTATTACTGTCAGCAGBHCT ACNHCBHCTWCACTTTTGGCGGAGGGACCAAG | CAGCAGBHCTACNHCBHCTWCACT | 940 | 1536 |
| VK4-01_t3_1_8 | GCTGAAGATGTGGCAGTTTATTACTGTCAGCAGBHCT ACNHCBHCMTCACTTTTGGCGGAGGGACCAAG | CAGCAGBHCTACNHCBHCMTCACT | 941 | 1537 |
| VK4-01_t3_2_8 | GCTGAAGATGTGGCAGTTTATTACTGTCAGCAGBHCT ACNHCBHCWGGACTTTTGGCGGAGGGACCAAG | CAGCAGBHCTACNHCBHCWGGACT | 942 | 1538 |
| VK4-01_t3_3_8 | GCTGAAGATGTGGCAGTTTATTACTGTCAGCAGBHCT ACNHCBHCCCTACTTTTGGCGGAGGGACCAAG | CAGCAGBHCTACNHCBHCCCTACT | 943 | 1539 |
| VK4-01_t4_0_8 | GCTGAAGATGTGGCAGTTTATTACTGTCAGCAGTACB HCNHCBHCTWCACTTTTGGCGGAGGGACCAAG | CAGCAGTACBHCNHCBHCTWCACT | 944 | 1540 |
| VK4-01_t4_1_8 | GCTGAAGATGTGGCAGTTTATTACTGTCAGCAGTACB HCNHCBHCMTCACTTTTGGCGGAGGGACCAAG | CAGCAGTACBHCNHCBHCMTCACT | 945 | 1541 |

TABLE 5-continued

Oligonucleotide sequences for exemplary VK jumping dimer and trimer sequences with CDRL3 length 8.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK4-01_t4_2_8 | GCTGAAGATGTGGCAGTTTATTACTGTCAGCAGTACBHCNHCBHCWGGACTTTTGGCGGAGGGACCAAG | CAGCAGTACBHCNHCBHCWGGACT | 946 | 1542 |
| VK4-01_t4_3_8 | GCTGAAGATGTGGCAGTTTATTACTGTCAGCAGTACBHCNHCBHCCCTACTTTTGGCGGAGGGACCAAG | CAGCAGTACBHCNHCBHCCCTACT | 947 | 1543 |

TABLE 6

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| Jumping Dimer | | | | |
| VK1-05_1_0_9 | CCTGATGATTTTGCAACTTATTACTGCSWMSWMTACAATAGTTACYCTTWCACTTTTGGCGGAGGGACCAAG | SWMSWMTACAATAGTTACYCTTWCACT | 1544 | 2168 |
| VK1-05_10_0_9 | CCTGATGATTTTGCAACTTATTACTGCCAGCAGBHCVRMAGTTACYCTTWCACTTTTGGCGGAGGGACCAAG | CAGCAGBHCVRMAGTTACYCTTWCACT | 1545 | 2169 |
| VK1-05_11_0_9 | CCTGATGATTTTGCAACTTATTACTGCCAGCAGBHCAATMBCTACYCTTWCACTTTTGGCGGAGGGACCAAG | CAGCAGBHCAATMBCTACYCTTWCACT | 1546 | 2170 |
| VK1-05_12_0_9 | CCTGATGATTTTGCAACTTATTACTGCCAGCAGBHCAATAGTYWCYCTTWCACTTTTGGCGGAGGGACCAAG | CAGCAGBHCAATAGTYWCYCTTWCACT | 1547 | 2171 |
| VK1-05_13_0_9 | CCTGATGATTTTGCAACTTATTACTGCCAGCAGTACVRMMBCTACYCTTWCACTTTTGGCGGAGGGACCAAG | CAGCAGTACVRMMBCTACYCTTWCACT | 1548 | 2172 |
| VK1-05_14_0_9 | CCTGATGATTTTGCAACTTATTACTGCCAGCAGTACVRMAGTYWCYCTTWCACTTTTGGCGGAGGGACCAAG | CAGCAGTACVRMAGTYWCYCTTWCACT | 1549 | 2173 |
| VK1-05_15_0_9 | CCTGATGATTTTGCAACTTATTACTGCCAGCAGTACAATMBCYWCYCTTWCACTTTTGGCGGAGGGACCAAG | CAGCAGTACAATMBCYWCYCTTWCACT | 1550 | 2174 |
| VK1-05_2_0_9 | CCTGATGATTTTGCAACTTATTACTGCSWMCAGBHCAATAGTTACYCTTWCACTTTTGGCGGAGGGACCAAG | SWMCAGBHCAATAGTTACYCTTWCACT | 1551 | 2175 |
| VK1-05_3_0_9 | CCTGATGATTTTGCAACTTATTACTGCSWMCAGTACVRMAGTTACYCTTWCACTTTTGGCGGAGGGACCAAG | SWMCAGTACVRMAGTTACYCTTWCACT | 1552 | 2176 |
| VK1-05_4_0_9 | CCTGATGATTTTGCAACTTATTACTGCSWMCAGTACAATMBCTACYCTTWCACTTTTGGCGGAGGGACCAAG | SWMCAGTACAATMBCTACYCTTWCACT | 1553 | 2177 |
| VK1-05_5_0_9 | CCTGATGATTTTGCAACTTATTACTGCSWMCAGTACAATAGTYWCYCTTWCACTTTTGGCGGAGGGACCAAG | SWMCAGTACAATAGTYWCYCTTWCACT | 1554 | 2178 |
| VK1-05_6_0_9 | CCTGATGATTTTGCAACTTATTACTGCCAGSWMBHCAATAGTTACYCTTWCACTTTTGGCGGAGGGACCAAG | CAGSWMBHCAATAGTTACYCTTWCACT | 1555 | 2179 |
| VK1-05_7_0_9 | CCTGATGATTTTGCAACTTATTACTGCCAGSWMTACVRMAGTTACYCTTWCACTTTTGGCGGAGGGACCAAG | CAGSWMTACVRMAGTTACYCTTWCACT | 1556 | 2180 |
| VK1-05_8_0_9 | CCTGATGATTTTGCAACTTATTACTGCCAGSWMTACAATMBCTACYCTTWCACTTTTGGCGGAGGGACCAAG | CAGSWMTACAATMBCTACYCTTWCACT | 1557 | 2181 |
| VK1-05_9_0_9 | CCTGATGATTTTGCAACTTATTACTGCCAGSWMTACAATAGTYWCYCTTWCACTTTTGGCGGAGGGACCAAG | CAGSWMTACAATAGTYWCYCTTWCACT | 1558 | 2182 |
| VK1-05_1_1_9 | CCTGATGATTTTGCAACTTATTACTGCSWMSWMTACAATAGTTACYCTMTCACTTTTGGCGGAGGGACCAAG | SWMSWMTACAATAGTTACYCTMTCACT | 1559 | 2183 |
| VK1-05_10_1_9 | CCTGATGATTTTGCAACTTATTACTGCCAGCAGBHCVRMAGTTACYCTMTCACTTTTGGCGGAGGGACCAAG | CAGCAGBHCVRMAGTTACYCTMTCACT | 1560 | 2184 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-05_11_1_9 | CCTGATGATTTTGCAACTTATTACTGCCAGCAGBHCAATMBCTACYCTMTCACTTTTGGCGGAGGGACCAAG | CAGCAGBHCAATMBCTACYCTMTCACT | 1561 | 2185 |
| VK1-05_12_1_9 | CCTGATGATTTTGCAACTTATTACTGCCAGCAGBHCAATAGTYWCYCTMTCACTTTTGGCGGAGGGACCAAG | CAGCAGBHCAATAGTYWCYCTMTCACT | 1562 | 2186 |
| VK1-05_13_1_9 | CCTGATGATTTTGCAACTTATTACTGCCAGCAGTACVRMMBCTACYCTMTCACTTTTGGCGGAGGGACCAAG | CAGCAGTACVRMMBCTACYCTMTCACT | 1563 | 2187 |
| VK1-05_14_1_9 | CCTGATGATTTTGCAACTTATTACTGCCAGCAGTACVRMAGTYWCYCTMTCACTTTTGGCGGAGGGACCAAG | CAGCAGTACVRMAGTYWCYCTMTCACT | 1564 | 2188 |
| VK1-05_15_1_9 | CCTGATGATTTTGCAACTTATTACTGCCAGCAGTACAATMBCYWCYCTMTCACTTTTGGCGGAGGGACCAAG | CAGCAGTACAATMBCYWCYCTMTCACT | 1565 | 2189 |
| VK1-05_2_1_9 | CCTGATGATTTTGCAACTTATTACTGCSWMCAGBHCAATAGTTACYCTMTCACTTTTGGCGGAGGGACCAAG | SWMCAGBHCAATAGTTACYCTMTCACT | 1566 | 2190 |
| VK1-05_3_1_9 | CCTGATGATTTTGCAACTTATTACTGCSWMCAGTACVRMAGTTACYCTMTCACTTTTGGCGGAGGGACCAAG | SWMCAGTACVRMAGTTACYCTMTCACT | 1567 | 2191 |
| VK1-05_4_1_9 | CCTGATGATTTTGCAACTTATTACTGCSWMCAGTACAATMBCTACYCTMTCACTTTTGGCGGAGGGACCAAG | SWMCAGTACAATMBCTACYCTMTCACT | 1568 | 2192 |
| VK1-05_5_1_9 | CCTGATGATTTTGCAACTTATTACTGCSWMCAGTACAATAGTYWCYCTMTCACTTTTGGCGGAGGGACCAAG | SWMCAGTACAATAGTYWCYCTMTCACT | 1569 | 2193 |
| VK1-05_6_1_9 | CCTGATGATTTTGCAACTTATTACTGCCAGSWMBHCAATAGTTACYCTMTCACTTTTGGCGGAGGGACCAAG | CAGSWMBHCAATAGTTACYCTMTCACT | 1570 | 2194 |
| VK1-05_7_1_9 | CCTGATGATTTTGCAACTTATTACTGCCAGSWMTACVRMAGTTACYCTMTCACTTTTGGCGGAGGGACCAAG | CAGSWMTACVRMAGTTACYCTMTCACT | 1571 | 2195 |
| VK1-05_8_1_9 | CCTGATGATTTTGCAACTTATTACTGCCAGSWMTACAATMBCTACYCTMTCACTTTTGGCGGAGGGACCAAG | CAGSWMTACAATMBCTACYCTMTCACT | 1572 | 2196 |
| VK1-05_9_1_9 | CCTGATGATTTTGCAACTTATTACTGCCAGSWMTACAATAGTYWCYCTMTCACTTTTGGCGGAGGGACCAAG | CAGSWMTACAATAGTYWCYCTMTCACT | 1573 | 2197 |
| VK1-05_1_2_9 | CCTGATGATTTTGCAACTTATTACTGCSWMSWMTACAATAGTTACYCTWGGACTTTTGGCGGAGGGACCAAG | SWMSWMTACAATAGTTACYCTWGGACT | 1574 | 2198 |
| VK1-05_10_2_9 | CCTGATGATTTTGCAACTTATTACTGCCAGCAGBHCVRMAGTTACYCTWGGACTTTTGGCGGAGGGACCAAG | CAGCAGBHCVRMAGTTACYCTWGGACT | 1575 | 2199 |
| VK1-05_11_2_9 | CCTGATGATTTTGCAACTTATTACTGCCAGCAGBHCAATMBCTACYCTWGGACTTTTGGCGGAGGGACCAAG | CAGCAGBHCAATMBCTACYCTWGGACT | 1576 | 2200 |
| VK1-05_12_2_9 | CCTGATGATTTTGCAACTTATTACTGCCAGCAGBHCAATAGTYWCYCTWGGACTTTTGGCGGAGGGACCAAG | CAGCAGBHCAATAGTYWCYCTWGGACT | 1577 | 2201 |
| VK1-05_13_2_9 | CCTGATGATTTTGCAACTTATTACTGCCAGCAGTACVRMMBCTACYCTWGGACTTTTGGCGGAGGGACCAAG | CAGCAGTACVRMMBCTACYCTWGGACT | 1578 | 2202 |
| VK1-05_14_2_9 | CCTGATGATTTTGCAACTTATTACTGCCAGCAGTACVRMAGTYWCYCTWGGACTTTTGGCGGAGGGACCAAG | CAGCAGTACVRMAGTYWCYCTWGGACT | 1579 | 2203 |
| VK1-05_15_2_9 | CCTGATGATTTTGCAACTTATTACTGCCAGCAGTACAATMBCYWCYCTWGGACTTTTGGCGGAGGGACCAAG | CAGCAGTACAATMBCYWCYCTWGGACT | 1580 | 2204 |
| VK1-05_2_2_9 | CCTGATGATTTTGCAACTTATTACTGCSWMCAGBHCAATAGTTACYCTWGGACTTTTGGCGGAGGGACCAAG | SWMCAGBHCAATAGTTACYCTWGGACT | 1581 | 2205 |
| VK1-05_3_2_9 | CCTGATGATTTTGCAACTTATTACTGCSWMCAGTACVRMAGTTACYCTWGGACTTTTGGCGGAGGGACCAAG | SWMCAGTACVRMAGTTACYCTWGGACT | 1582 | 2206 |
| VK1-05_4_2_9 | CCTGATGATTTTGCAACTTATTACTGCSWMCAGTACAATMBCTACYCTWGGACTTTTGGCGGAGGGACCAAG | SWMCAGTACAATMBCTACYCTWGGACT | 1583 | 2207 |
| VK1-05_5_2_9 | CCTGATGATTTTGCAACTTATTACTGCSWMCAGTACAATAGTYWCYCTWGGACTTTTGGCGGAGGGACCAAG | SWMCAGTACAATAGTYWCYCTWGGACT | 1584 | 2208 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-05_6_2_9 | CCTGATGATTTTGCAACTTATTACTGCCAGSWMBHCAATAGTTACYCTWGGACTTTTGGCGGAGGGACCAAG | CAGSWMBHCAATAGTTACYCTWGGACT | 1585 | 2209 |
| VK1-05_7_2_9 | CCTGATGATTTTGCAACTTATTACTGCCAGSWMTACVRMAGTTACYCTWGGACTTTTGGCGGAGGGACCAAG | CAGSWMTACVRMAGTTACYCTWGGACT | 1586 | 2210 |
| VK1-05_8_2_9 | CCTGATGATTTTGCAACTTATTACTGCCAGSWMTACAATMBCTACYCTWGGACTTTTGGCGGAGGGACCAAG | CAGSWMTACAATMBCTACYCTWGGACT | 1587 | 2211 |
| VK1-05_9_2_9 | CCTGATGATTTTGCAACTTATTACTGCCAGSWMTACAATAGTYWCYCTWGGACTTTTGGCGGAGGGACCAAG | CAGSWMTACAATAGTYWCYCTWGGACT | 1588 | 2212 |
| VK1-05_1_3_9 | CCTGATGATTTTGCAACTTATTACTGCSWMSWMTACAATAGTTACYCTCCTACTTTTGGCGGAGGGACCAAG | SWMSWMTACAATAGTTACYCTCCTACT | 1589 | 2213 |
| VK1-05_10_3_9 | CCTGATGATTTTGCAACTTATTACTGCCAGCAGBHCVRMAGTTACYCTCCTACTTTTGGCGGAGGGACCAAG | CAGCAGBHCVRMAGTTACYCTCCTACT | 1590 | 2214 |
| VK1-05_11_3_9 | CCTGATGATTTTGCAACTTATTACTGCCAGCAGBHCAATMBCTACYCTCCTACTTTTGGCGGAGGGACCAAG | CAGCAGBHCAATMBCTACYCTCCTACT | 1591 | 2215 |
| VK1-05_12_3_9 | CCTGATGATTTTGCAACTTATTACTGCCAGCAGBHCAATAGTYWCYCTCCTACTTTTGGCGGAGGGACCAAG | CAGCAGBHCAATAGTYWCYCTCCTACT | 1592 | 2216 |
| VK1-05_13_3_9 | CCTGATGATTTTGCAACTTATTACTGCCAGCAGTACVRMMBCTACYCTCCTACTTTTGGCGGAGGGACCAAG | CAGCAGTACVRMMBCTACYCTCCTACT | 1593 | 2217 |
| VK1-05_14_3_9 | CCTGATGATTTTGCAACTTATTACTGCCAGCAGTACVRMAGTYWCYCTCCTACTTTTGGCGGAGGGACCAAG | CAGCAGTACVRMAGTYWCYCTCCTACT | 1594 | 2218 |
| VK1-05_15_3_9 | CCTGATGATTTTGCAACTTATTACTGCCAGCAGTACAATMBCYWCYCTCCTACTTTTGGCGGAGGGACCAAG | CAGCAGTACAATMBCYWCYCTCCTACT | 1595 | 2219 |
| VK1-05_2_3_9 | CCTGATGATTTTGCAACTTATTACTGCSWMCAGBHCAATAGTTACYCTCCTACTTTTGGCGGAGGGACCAAG | SWMCAGBHCAATAGTTACYCTCCTACT | 1596 | 2220 |
| VK1-05_3_3_9 | CCTGATGATTTTGCAACTTATTACTGCSWMCAGTACVRMAGTTACYCTCCTACTTTTGGCGGAGGGACCAAG | SWMCAGTACVRMAGTTACYCTCCTACT | 1597 | 2221 |
| VK1-05_4_3_9 | CCTGATGATTTTGCAACTTATTACTGCSWMCAGTACAATMBCTACYCTCCTACTTTTGGCGGAGGGACCAAG | SWMCAGTACAATMBCTACYCTCCTACT | 1598 | 2222 |
| VK1-05_5_3_9 | CCTGATGATTTTGCAACTTATTACTGCSWMCAGTACAATAGTYWCYCTCCTACTTTTGGCGGAGGGACCAAG | SWMCAGTACAATAGTYWCYCTCCTACT | 1599 | 2223 |
| VK1-05_6_3_9 | CCTGATGATTTTGCAACTTATTACTGCCAGSWMBHCAATAGTTACYCTCCTACTTTTGGCGGAGGGACCAAG | CAGSWMBHCAATAGTTACYCTCCTACT | 1600 | 2224 |
| VK1-05_7_3_9 | CCTGATGATTTTGCAACTTATTACTGCCAGSWMTACVRMAGTTACYCTCCTACTTTTGGCGGAGGGACCAAG | CAGSWMTACVRMAGTTACYCTCCTACT | 1601 | 2225 |
| VK1-05_8_3_9 | CCTGATGATTTTGCAACTTATTACTGCCAGSWMTACAATMBCTACYCTCCTACTTTTGGCGGAGGGACCAAG | CAGSWMTACAATMBCTACYCTCCTACT | 1602 | 2226 |
| VK1-05_9_3_9 | CCTGATGATTTTGCAACTTATTACTGCCAGSWMTACAATAGTYWCYCTCCTACTTTTGGCGGAGGGACCAAG | CAGSWMTACAATAGTYWCYCTCCTACT | 1603 | 2227 |
| VK1-12_1_0_9 | CCTGAAGATTTTGCAACTTATTACTGTSWMSWMGCAAATAGTTTCCCTTWCACTTTTGGCGGAGGGACCAAG | SWMSWMGCAAATAGTTTCCCTTWCACT | 1604 | 2228 |
| VK1-12_10_0_9 | CCTGAAGATTTTGCAACTTATTACTGTCAGCAGRNANHCAGTTTCCCTTWCACTTTTGGCGGAGGGACCAAG | CAGCAGRNANHCAGTTTCCCTTWCACT | 1605 | 2229 |
| VK1-12_11_0_9 | CCTGAAGATTTTGCAACTTATTACTGTCAGCAGRNAAATNHCTTCCCTTWCACTTTTGGCGGAGGGACCAAG | CAGCAGRNAAATNHCTTCCCTTWCACT | 1606 | 2230 |
| VK1-12_12_0_9 | CCTGAAGATTTTGCAACTTATTACTGTCAGCAGRNAAATAGTYWCCCTTWCACTTTTGGCGGAGGGACCAAG | CAGCAGRNAAATAGTYWCCCTTWCACT | 1607 | 2231 |
| VK1-12_13_0_9 | CCTGAAGATTTTGCAACTTATTACTGTCAGCAGGCANHCNHCTTCCCTTWCACTTTTGGCGGAGGGACCAAG | CAGCAGGCANHCNHCTTCCCTTWCACT | 1608 | 2232 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_14_0_9 | CCTGAAGATTTTGCAACTTATTACTGTCAGCAGGCANHCAGTYWCCCTTWCACTTTTGGCGGAGGGACCAAG | CAGCAGGCANHCAGTYWCCCTTWCACT | 1609 | 2233 |
| VK1-12_15_0_9 | CCTGAAGATTTTGCAACTTATTACTGTCAGCAGGCAAATNHCYWCCCTTWCACTTTTGGCGGAGGGACCAAG | CAGCAGGCAAATNHCYWCCCTTWCACT | 1610 | 2234 |
| VK1-12_2_0_9 | CCTGAAGATTTTGCAACTTATTACTGTSWMCAGRNAAATAGTTTCCCTTWCACTTTTGGCGGAGGGACCAAG | SWMCAGRNAAATAGTTTCCCTTWCACT | 1611 | 2235 |
| VK1-12_3_0_9 | CCTGAAGATTTTGCAACTTATTACTGTSWMCAGGCANHCAGTTTCCCTTWCACTTTTGGCGGAGGGACCAAG | SWMCAGGCANHCAGTTTCCCTTWCACT | 1612 | 2236 |
| VK1-12_4_0_9 | CCTGAAGATTTTGCAACTTATTACTGTSWMCAGGCAAATNHCTTCCCTTWCACTTTTGGCGGAGGGACCAAG | SWMCAGGCAAATNHCTTCCCTTWCACT | 1613 | 2237 |
| VK1-12_5_0_9 | CCTGAAGATTTTGCAACTTATTACTGTSWMCAGGCAAATAGTYWCCCTTWCACTTTTGGCGGAGGGACCAAG | SWMCAGGCAAATAGTYWCCCTTWCACT | 1614 | 2238 |
| VK1-12_6_0_9 | CCTGAAGATTTTGCAACTTATTACTGTCAGSWMRNAAATAGTTTCCCTTWCACTTTTGGCGGAGGGACCAAG | CAGSWMRNAAATAGTTTCCCTTWCACT | 1615 | 2239 |
| VK1-12_7_0_9 | CCTGAAGATTTTGCAACTTATTACTGTCAGSWMGCANHCAGTTTCCCTTWCACTTTTGGCGGAGGGACCAAG | CAGSWMGCANHCAGTTTCCCTTWCACT | 1616 | 2240 |
| VK1-12_8_0_9 | CCTGAAGATTTTGCAACTTATTACTGTCAGSWMGCAAATNHCTTCCCTTWCACTTTTGGCGGAGGGACCAAG | CAGSWMGCAAATNHCTTCCCTTWCACT | 1617 | 2241 |
| VK1-12_9_0_9 | CCTGAAGATTTTGCAACTTATTACTGTCAGSWMGCAAATAGTYWCCCTTWCACTTTTGGCGGAGGGACCAAG | CAGSWMGCAAATAGTYWCCCTTWCACT | 1618 | 2242 |
| VK1-12_1_1_9 | CCTGAAGATTTTGCAACTTATTACTGTSWMSWMGCAAATAGTTTCCCTMTCACTTTTGGCGGAGGGACCAAG | SWMSWMGCAAATAGTTTCCCTMTCACT | 1619 | 2243 |
| VK1-12_10_1_9 | CCTGAAGATTTTGCAACTTATTACTGTCAGCAGRNANHCAGTTTCCCTMTCACTTTTGGCGGAGGGACCAAG | CAGCAGRNANHCAGTTTCCCTMTCACT | 1620 | 2244 |
| VK1-12_11_1_9 | CCTGAAGATTTTGCAACTTATTACTGTCAGCAGRNAAATNHCTTCCCTMTCACTTTTGGCGGAGGGACCAAG | CAGCAGRNAAATNHCTTCCCTMTCACT | 1621 | 2245 |
| VK1-12_12_1_9 | CCTGAAGATTTTGCAACTTATTACTGTCAGCAGRNAAATAGTYWCCCTMTCACTTTTGGCGGAGGGACCAAG | CAGCAGRNAAATAGTYWCCCTMTCACT | 1622 | 2246 |
| VK1-12_13_1_9 | CCTGAAGATTTTGCAACTTATTACTGTCAGCAGGCANHCNHCTTCCCTMTCACTTTTGGCGGAGGGACCAAG | CAGCAGGCANHCNHCTTCCCTMTCACT | 1623 | 2247 |
| VK1-12_14_1_9 | CCTGAAGATTTTGCAACTTATTACTGTCAGCAGGCANHCAGTYWCCCTMTCACTTTTGGCGGAGGGACCAAG | CAGCAGGCANHCAGTYWCCCTMTCACT | 1624 | 2248 |
| VK1-12_15_1_9 | CCTGAAGATTTTGCAACTTATTACTGTCAGCAGGCAAATNHCYWCCCTMTCACTTTTGGCGGAGGGACCAAG | CAGCAGGCAAATNHCYWCCCTMTCACT | 1625 | 2249 |
| VK1-12_2_1_9 | CCTGAAGATTTTGCAACTTATTACTGTSWMCAGRNAAATAGTTTCCCTMTCACTTTTGGCGGAGGGACCAAG | SWMCAGRNAAATAGTTTCCCTMTCACT | 1626 | 2250 |
| VK1-12_3_1_9 | CCTGAAGATTTTGCAACTTATTACTGTSWMCAGGCANHCAGTTTCCCTMTCACTTTTGGCGGAGGGACCAAG | SWMCAGGCANHCAGTTTCCCTMTCACT | 1627 | 2251 |
| VK1-12_4_1_9 | CCTGAAGATTTTGCAACTTATTACTGTSWMCAGGCAAATNHCTTCCCTMTCACTTTTGGCGGAGGGACCAAG | SWMCAGGCAAATNHCTTCCCTMTCACT | 1628 | 2252 |
| VK1-12_5_1_9 | CCTGAAGATTTTGCAACTTATTACTGTSWMCAGGCAAATAGTYWCCCTMTCACTTTTGGCGGAGGGACCAAG | SWMCAGGCAAATAGTYWCCCTMTCACT | 1629 | 2253 |
| VK1-12_6_1_9 | CCTGAAGATTTTGCAACTTATTACTGTCAGSWMRNAAATAGTTTCCCTMTCACTTTTGGCGGAGGGACCAAG | CAGSWMRNAAATAGTTTCCCTMTCACT | 1630 | 2254 |
| VK1-12_7_1_9 | CCTGAAGATTTTGCAACTTATTACTGTCAGSWMGCANHCAGTTTCCCTMTCACTTTTGGCGGAGGGACCAAG | CAGSWMGCANHCAGTTTCCCTMTCACT | 1631 | 2255 |
| VK1-12_8_1_9 | CCTGAAGATTTTGCAACTTATTACTGTCAGSWMGCAAATNHCTTCCCTMTCACTTTTGGCGGAGGGACCAAG | CAGSWMGCAAATNHCTTCCCTMTCACT | 1632 | 2256 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_9_1_9 | CCTGAAGATTTTGCAACTTATTACTGTCAGSWMGCAAATAGTYWCCCTMTCACTTTTGGCGGAGGGACCAAG | CAGSWMGCAAATAGTYWCCCTMTCACT | 1633 | 2257 |
| VK1-12_1_2_9 | CCTGAAGATTTTGCAACTTATTACTGTSWMSWMGCAAATAGTTTCCCTWGGACTTTTGGCGGAGGGACCAAG | SWMSWMGCAAATAGTTTCCCTWGGACT | 1634 | 2258 |
| VK1-12_10_2_9 | CCTGAAGATTTTGCAACTTATTACTGTCAGCAGRNANHCAGTTTCCCTWGGACTTTTGGCGGAGGGACCAAG | CAGCAGRNANHCAGTTTCCCTWGGACT | 1635 | 2259 |
| VK1-12_11_2_9 | CCTGAAGATTTTGCAACTTATTACTGTCAGCAGRNAAATNHCTTCCCTWGGACTTTTGGCGGAGGGACCAAG | CAGCAGRNAAATNHCTTCCCTWGGACT | 1636 | 2260 |
| VK1-12_12_2_9 | CCTGAAGATTTTGCAACTTATTACTGTCAGCAGRNAAATAGTYWCCCTWGGACTTTTGGCGGAGGGACCAAG | CAGCAGRNAAATAGTYWCCCTWGGACT | 1637 | 2261 |
| VK1-12_13_2_9 | CCTGAAGATTTTGCAACTTATTACTGTCAGCAGGCANHCNHCTTCCCTWGGACTTTTGGCGGAGGGACCAAG | CAGCAGGCANHCNHCTTCCCTWGGACT | 1638 | 2262 |
| VK1-12_14_2_9 | CCTGAAGATTTTGCAACTTATTACTGTCAGCAGGCANHCAGTYWCCCTWGGACTTTTGGCGGAGGGACCAAG | CAGCAGGCANHCAGTYWCCCTWGGACT | 1639 | 2263 |
| VK1-12_15_2_9 | CCTGAAGATTTTGCAACTTATTACTGTCAGCAGGCAAATNHCYWCCCTWGGACTTTTGGCGGAGGGACCAAG | CAGCAGGCAAATNHCYWCCCTWGGACT | 1640 | 2264 |
| VK1-12_2_2_9 | CCTGAAGATTTTGCAACTTATTACTGTSWMCAGRNAAATAGTTTCCCTWGGACTTTTGGCGGAGGGACCAAG | SWMCAGRNAAATAGTTTCCCTWGGACT | 1641 | 2265 |
| VK1-12_3_2_9 | CCTGAAGATTTTGCAACTTATTACTGTSWMCAGGCANHCAGTTTCCCTWGGACTTTTGGCGGAGGGACCAAG | SWMCAGGCANHCAGTTTCCCTWGGACT | 1642 | 2266 |
| VK1-12_4_2_9 | CCTGAAGATTTTGCAACTTATTACTGTSWMCAGGCAAATNHCTTCCCTWGGACTTTTGGCGGAGGGACCAAG | SWMCAGGCAAATNHCTTCCCTWGGACT | 1643 | 2267 |
| VK1-12_5_2_9 | CCTGAAGATTTTGCAACTTATTACTGTSWMCAGGCAAATAGTYWCCCTWGGACTTTTGGCGGAGGGACCAAG | SWMCAGGCAAATAGTYWCCCTWGGACT | 1644 | 2268 |
| VK1-12_6_2_9 | CCTGAAGATTTTGCAACTTATTACTGTCAGSWMRNAAATAGTTTCCCTWGGACTTTTGGCGGAGGGACCAAG | CAGSWMRNAAATAGTTTCCCTWGGACT | 1645 | 2269 |
| VK1-12_7_2_9 | CCTGAAGATTTTGCAACTTATTACTGTCAGSWMGCANHCAGTTTCCCTWGGACTTTTGGCGGAGGGACCAAG | CAGSWMGCANHCAGTTTCCCTWGGACT | 1646 | 2270 |
| VK1-12_8_2_9 | CCTGAAGATTTTGCAACTTATTACTGTCAGSWMGCAAATNHCTTCCCTWGGACTTTTGGCGGAGGGACCAAG | CAGSWMGCAAATNHCTTCCCTWGGACT | 1647 | 2271 |
| VK1-12_9_2_9 | CCTGAAGATTTTGCAACTTATTACTGTCAGSWMGCAAATAGTYWCCCTWGGACTTTTGGCGGAGGGACCAAG | CAGSWMGCAAATAGTYWCCCTWGGACT | 1648 | 2272 |
| VK1-12_1_3_9 | CCTGAAGATTTTGCAACTTATTACTGTSWMSWMGCAAATAGTTTCCCTCCTACTTTTGGCGGAGGGACCAAG | SWMSWMGCAAATAGTTTCCCTCCTACT | 1649 | 2273 |
| VK1-12_10_3_9 | CCTGAAGATTTTGCAACTTATTACTGTCAGCAGRNANHCAGTTTCCCTCCTACTTTTGGCGGAGGGACCAAG | CAGCAGRNANHCAGTTTCCCTCCTACT | 1650 | 2274 |
| VK1-12_11_3_9 | CCTGAAGATTTTGCAACTTATTACTGTCAGCAGRNAAATNHCTTCCCTCCTACTTTTGGCGGAGGGACCAAG | CAGCAGRNAAATNHCTTCCCTCCTACT | 1651 | 2275 |
| VK1-12_12_3_9 | CCTGAAGATTTTGCAACTTATTACTGTCAGCAGRNAAATAGTYWCCCTCCTACTTTTGGCGGAGGGACCAAG | CAGCAGRNAAATAGTYWCCCTCCTACT | 1652 | 2276 |
| VK1-12_13_3_9 | CCTGAAGATTTTGCAACTTATTACTGTCAGCAGGCANHCNHCTTCCCTCCTACTTTTGGCGGAGGGACCAAG | CAGCAGGCANHCNHCTTCCCTCCTACT | 1653 | 2277 |
| VK1-12_14_3_9 | CCTGAAGATTTTGCAACTTATTACTGTCAGCAGGCANHCAGTYWCCCTCCTACTTTTGGCGGAGGGACCAAG | CAGCAGGCANHCAGTYWCCCTCCTACT | 1654 | 2278 |
| VK1-12_15_3_9 | CCTGAAGATTTTGCAACTTATTACTGTCAGCAGGCAAATNHCYWCCCTCCTACTTTTGGCGGAGGGACCAAG | CAGCAGGCAAATNHCYWCCCTCCTACT | 1655 | 2279 |
| VK1-12_2_3_9 | CCTGAAGATTTTGCAACTTATTACTGTSWMCAGRNAAATAGTTTCCCTCCTACTTTTGGCGGAGGGACCAAG | SWMCAGRNAAATAGTTTCCCTCCTACT | 1656 | 2280 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK1-12_3_3_9 | CCTGAAGATTTTGCAACTTATTACTGTSWMCAGGCANHCAGTTTCCCTCCTACTTTTGGCGGAGGGACCAAG | SWMCAGGCANHCAGTTTCCCTCCTACT | 1657 | 2281 |
| VK1-12_4_3_9 | CCTGAAGATTTTGCAACTTATTACTGTSWMCAGGCAAATNHCTTCCCTCCTACTTTTGGCGGAGGGACCAAG | SWMCAGGCAAATNHCTTCCCTCCTACT | 1658 | 2282 |
| VK1-12_5_3_9 | CCTGAAGATTTTGCAACTTATTACTGTSWMCAGGCAAATAGTYWCCCTCCTACTTTTGGCGGAGGGACCAAG | SWMCAGGCAAATAGTYWCCCTCCTACT | 1659 | 2283 |
| VK1-12_6_3_9 | CCTGAAGATTTTGCAACTTATTACTGTCAGSWMRNAAATAGTTTCCCTCCTACTTTTGGCGGAGGGACCAAG | CAGSWMRNAAATAGTTTCCCTCCTACT | 1660 | 2284 |
| VK1-12_7_3_9 | CCTGAAGATTTTGCAACTTATTACTGTCAGSWMGCANHCAGTTTCCCTCCTACTTTTGGCGGAGGGACCAAG | CAGSWMGCANHCAGTTTCCCTCCTACT | 1661 | 2285 |
| VK1-12_8_3_9 | CCTGAAGATTTTGCAACTTATTACTGTCAGSWMGCAAATNHCTTCCCTCCTACTTTTGGCGGAGGGACCAAG | CAGSWMGCAAATNHCTTCCCTCCTACT | 1662 | 2286 |
| VK1-12_9_3_9 | CCTGAAGATTTTGCAACTTATTACTGTCAGSWMGCAAATAGTYWCCCTCCTACTTTTGGCGGAGGGACCAAG | CAGSWMGCAAATAGTYWCCCTCCTACT | 1663 | 2287 |
| VK1-33_1_0_9 | CCTGAAGATATTGCAACATATTACTGTSWMSWMTACGATAATCTCCCTTWCACTTTTGGCGGAGGGACCAAG | SWMSWMTACGATAATCTCCCTTWCACT | 1664 | 2288 |
| VK1-33_10_0_9 | CCTGAAGATATTGCAACATATTACTGTCAGCAGBHCNHCAATCTCCCTTWCACTTTTGGCGGAGGGACCAAG | CAGCAGBHCNHCAATCTCCCTTWCACT | 1665 | 2289 |
| VK1-33_11_0_9 | CCTGAAGATATTGCAACATATTACTGTCAGCAGBHCGATNHCCTCCCTTWCACTTTTGGCGGAGGGACCAAG | CAGCAGBHCGATNHCCTCCCTTWCACT | 1666 | 2290 |
| VK1-33_12_0_9 | CCTGAAGATATTGCAACATATTACTGTCAGCAGBHCGATAATYWCCCTTWCACTTTTGGCGGAGGGACCAAG | CAGCAGBHCGATAATYWCCCTTWCACT | 1667 | 2291 |
| VK1-33_13_0_9 | CCTGAAGATATTGCAACATATTACTGTCAGCAGTACNHCNHCCTCCCTTWCACTTTTGGCGGAGGGACCAAG | CAGCAGTACNHCNHCCTCCCTTWCACT | 1668 | 2292 |
| VK1-33_14_0_9 | CCTGAAGATATTGCAACATATTACTGTCAGCAGTACNHCAATYWCCCTTWCACTTTTGGCGGAGGGACCAAG | CAGCAGTACNHCAATYWCCCTTWCACT | 1669 | 2293 |
| VK1-33_15_0_9 | CCTGAAGATATTGCAACATATTACTGTCAGCAGTACGATNHCYWCCCTTCACTTTTGGCGGAGGGACCAAG | CAGCAGTACGATNHCYWCCCTTWCACT | 1670 | 2294 |
| VK1-33_2_0_9 | CCTGAAGATATTGCAACATATTACTGTSWMCAGBHCGATAATCTCCCTTWCACTTTTGGCGGAGGGACCAAG | SWMCAGBHCGATAATCTCCCTTWCACT | 1671 | 2295 |
| VK1-33_3_0_9 | CCTGAAGATATTGCAACATATTACTGTSWMCAGTACNHCAATCTCCCTTWCACTTTTGGCGGAGGGACCAAG | SWMCAGTACNHCAATCTCCCTTWCACT | 1672 | 2296 |
| VK1-33_4_0_9 | CCTGAAGATATTGCAACATATTACTGTSWMCAGTACGATNHCCTCCCTTWCACTTTTGGCGGAGGGACCAAG | SWMCAGTACGATNHCCTCCCTTWCACT | 1673 | 2297 |
| VK1-33_5_0_9 | CCTGAAGATATTGCAACATATTACTGTSWMCAGTACGATAATYWCCCTTWCACTTTTGGCGGAGGGACCAAG | SWMCAGTACGATAATYWCCCTTWCACT | 1674 | 2298 |
| VK1-33_6_0_9 | CCTGAAGATATTGCAACATATTACTGTCAGSWMBHCGATAATCTCCCTTWCACTTTTGGCGGAGGGACCAAG | CAGSWMBHCGATAATCTCCCTTWCACT | 1675 | 2299 |
| VK1-33_7_0_9 | CCTGAAGATATTGCAACATATTACTGTCAGSWMTACNHCAATCTCCCTTWCACTTTTGGCGGAGGGACCAAG | CAGSWMTACNHCAATCTCCCTTWCACT | 1676 | 2300 |
| VK1-33_8_0_9 | CCTGAAGATATTGCAACATATTACTGTCAGSWMTACGATNHCCTCCCTTWCACTTTTGGCGGAGGGACCAAG | CAGSWMTACGATNHCCTCCCTTWCACT | 1677 | 2301 |
| VK1-33_9_0_9 | CCTGAAGATATTGCAACATATTACTGTCAGSWMTACGATAATYWCCCTTWCACTTTTGGCGGAGGGACCAAG | CAGSWMTACGATAATYWCCCTTWCACT | 1678 | 2302 |
| VK1-33_1_1_9 | CCTGAAGATATTGCAACATATTACTGTSWMSWMTACGATAATCTCCCTMTCACTTTTGGCGGAGGGACCAAG | SWMSWMTACGATAATCTCCCTMTCACT | 1679 | 2303 |
| VK1-33_10_1_9 | CCTGAAGATATTGCAACATATTACTGTCAGCAGBHCNHCAATCTCCCTMTCACTTTTGGCGGAGGGACCAAG | CAGCAGBHCNHCAATCTCCCTMTCACT | 1680 | 2304 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK1-33_11_1_9 | CCTGAAGATATTGCAACATATTACTGTCAGCAGBHCGATNHCCTCCCTMTCACTTTTGGCGGAGGGACCAAG | CAGCAGBHCGATNHCCTCCCTMTCACT | 1681 | 2305 |
| VK1-33_12_1_9 | CCTGAAGATATTGCAACATATTACTGTCAGCAGBHCGATAATYWCCCTMTCACTTTTGGCGGAGGGACCAAG | CAGCAGBHCGATAATYWCCCTMTCACT | 1682 | 2306 |
| VK1-33_13_1_9 | CCTGAAGATATTGCAACATATTACTGTCAGCAGTACNHCNHCCTCCCTMTCACTTTTGGCGGAGGGACCAAG | CAGCAGTACNHCNHCCTCCCTMTCACT | 1683 | 2307 |
| VK1-33_14_1_9 | CCTGAAGATATTGCAACATATTACTGTCAGCAGTACNHCAATYWCCCTMTCACTTTTGGCGGAGGGACCAAG | CAGCAGTACNHCAATYWCCCTMTCACT | 1684 | 2308 |
| VK1-33_15_1_9 | CCTGAAGATATTGCAACATATTACTGTCAGCAGTACGATNHCYWCCCTMTCACTTTTGGCGGAGGGACCAAG | CAGCAGTACGATNHCYWCCCTMTCACT | 1685 | 2309 |
| VK1-33_2_1_9 | CCTGAAGATATTGCAACATATTACTGTSWMCAGBHCGATAATCTCCCTMTCACTTTTGGCGGAGGGACCAAG | SWMCAGBHCGATAATCTCCCTMTCACT | 1686 | 2310 |
| VK1-33_3_1_9 | CCTGAAGATATTGCAACATATTACTGTSWMCAGTACNHCAATCTCCCTMTCACTTTTGGCGGAGGGACCAAG | SWMCAGTACNHCAATCTCCCTMTCACT | 1687 | 2311 |
| VK1-33_4_1_9 | CCTGAAGATATTGCAACATATTACTGTSWMCAGTACGATNHCCTCCCTMTCACTTTTGGCGGAGGGACCAAG | SWMCAGTACGATNHCCTCCCTMTCACT | 1688 | 2312 |
| VK1-33_5_1_9 | CCTGAAGATATTGCAACATATTACTGTSWMCAGTACGATAATYWCCCTMTCACTTTTGGCGGAGGGACCAAG | SWMCAGTACGATAATYWCCCTMTCACT | 1689 | 2313 |
| VK1-33_6_1_9 | CCTGAAGATATTGCAACATATTACTGTCAGSWMBHCGATAATCTCCCTMTCACTTTTGGCGGAGGGACCAAG | CAGSWMBHCGATAATCTCCCTMTCACT | 1690 | 2314 |
| VK1-33_7_1_9 | CCTGAAGATATTGCAACATATTACTGTCAGSWMTACNHCAATCTCCCTMTCACTTTTGGCGGAGGGACCAAG | CAGSWMTACNHCAATCTCCCTMTCACT | 1691 | 2315 |
| VK1-33_8_1_9 | CCTGAAGATATTGCAACATATTACTGTCAGSWMTACGATNHCCTCCCTMTCACTTTTGGCGGAGGGACCAAG | CAGSWMTACGATNHCCTCCCTMTCACT | 1692 | 2316 |
| VK1-33_9_1_9 | CCTGAAGATATTGCAACATATTACTGTCAGSWMTACGATAATYWCCCTMTCACTTTTGGCGGAGGGACCAAG | CAGSWMTACGATAATYWCCCTMTCACT | 1693 | 2317 |
| VK1-33_1_2_9 | CCTGAAGATATTGCAACATATTACTGTSWMSWMTACGATAATCTCCCTWGGACTTTTGGCGGAGGGACCAAG | SWMSWMTACGATAATCTCCCTWGGACT | 1694 | 2318 |
| VK1-33_10_2_9 | CCTGAAGATATTGCAACATATTACTGTCAGCAGBHCNHCAATCTCCCTWGGACTTTTGGCGGAGGGACCAAG | CAGCAGBHCNHCAATCTCCCTWGGACT | 1695 | 2319 |
| VK1-33_11_2_9 | CCTGAAGATATTGCAACATATTACTGTCAGCAGBHCGATNHCCTCCCTWGGACTTTTGGCGGAGGGACCAAG | CAGCAGBHCGATNHCCTCCCTWGGACT | 1696 | 2320 |
| VK1-33_12_2_9 | CCTGAAGATATTGCAACATATTACTGTCAGCAGBHCGATAATYWCCCTWGGACTTTTGGCGGAGGGACCAAG | CAGCAGBHCGATAATYWCCCTWGGACT | 1697 | 2321 |
| VK1-33_13_2_9 | CCTGAAGATATTGCAACATATTACTGTCAGCAGTACNHCNHCCTCCCTWGGACTTTTGGCGGAGGGACCAAG | CAGCAGTACNHCNHCCTCCCTWGGACT | 1698 | 2322 |
| VK1-33_14_2_9 | CCTGAAGATATTGCAACATATTACTGTCAGCAGTACNHCAATYWCCCTWGGACTTTTGGCGGAGGGACCAAG | CAGCAGTACNHCAATYWCCCTWGGACT | 1699 | 2323 |
| VK1-33_15_2_9 | CCTGAAGATATTGCAACATATTACTGTCAGCAGTACGATNHCYWCCCTWGGACTTTTGGCGGAGGGACCAAG | CAGCAGTACGATNHCYWCCCTWGGACT | 1700 | 2324 |
| VK1-33_2_2_9 | CCTGAAGATATTGCAACATATTACTGTSWMCAGBHCGATAATCTCCCTWGGACTTTTGGCGGAGGGACCAAG | SWMCAGBHCGATAATCTCCCTWGGACT | 1701 | 2325 |
| VK1-33_3_2_9 | CCTGAAGATATTGCAACATATTACTGTSWMCAGTACNHCAATCTCCCTWGGACTTTTGGCGGAGGGACCAAG | SWMCAGTACNHCAATCTCCCTWGGACT | 1702 | 2326 |
| VK1-33_4_2_9 | CCTGAAGATATTGCAACATATTACTGTSWMCAGTACGATNHCCTCCCTWGGACTTTTGGCGGAGGGACCAAG | SWMCAGTACGATNHCCTCCCTWGGACT | 1703 | 2327 |
| VK1-33_5_2_9 | CCTGAAGATATTGCAACATATTACTGTSWMCAGTACGATAATYWCCCTWGGACTTTTGGCGGAGGGACCAAG | SWMCAGTACGATAATYWCCCTWGGACT | 1704 | 2328 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_6_2_9 | CCTGAAGATATTGCAACATATTACTGTCAGSWMBHCGATAATCTCCCTWGGACTTTTGGCGGAGGGACCAAG | CAGSWMBHCGATAATCTCCCTWGGACT | 1705 | 2329 |
| VK1-33_7_2_9 | CCTGAAGATATTGCAACATATTACTGTCAGSWMTACNHCAATCTCCCTWGGACTTTTGGCGGAGGGACCAAG | CAGSWMTACNHCAATCTCCCTWGGACT | 1706 | 2330 |
| VK1-33_8_2_9 | CCTGAAGATATTGCAACATATTACTGTCAGSWMTACGATNHCCTCCCTWGGACTTTTGGCGGAGGGACCAAG | CAGSWMTACGATNHCCTCCCTWGGACT | 1707 | 2331 |
| VK1-33_9_2_9 | CCTGAAGATATTGCAACATATTACTGTCAGSWMTACGATAATYWCCCTWGGACTTTTGGCGGAGGGACCAAG | CAGSWMTACGATAATYWCCCTWGGACT | 1708 | 2332 |
| VK1-33_1_3_9 | CCTGAAGATATTGCAACATATTACTGTSWMSWMTACGATAATCTCCCTCCTACTTTTGGCGGAGGGACCAAG | SWMSWMTACGATAATCTCCCTCCTACT | 1709 | 2333 |
| VK1-33_10_3_9 | CCTGAAGATATTGCAACATATTACTGTCAGCAGBHCNHCAATCTCCCTCCTACTTTTGGCGGAGGGACCAAG | CAGCAGBHCNHCAATCTCCCTCCTACT | 1710 | 2334 |
| VK1-33_11_3_9 | CCTGAAGATATTGCAACATATTACTGTCAGCAGBHCGATNHCCTCCCTCCTACTTTTGGCGGAGGGACCAAG | CAGCAGBHCGATNHCCTCCCTCCTACT | 1711 | 2335 |
| VK1-33_12_3_9 | CCTGAAGATATTGCAACATATTACTGTCAGCAGBHCGATAATYWCCCTCCTACTTTTGGCGGAGGGACCAAG | CAGCAGBHCGATAATYWCCCTCCTACT | 1712 | 2336 |
| VK1-33_13_3_9 | CCTGAAGATATTGCAACATATTACTGTCAGCAGTACNHCNHCCTCCCTCCTACTTTTGGCGGAGGGACCAAG | CAGCAGTACNHCNHCCTCCCTCCTACT | 1713 | 2337 |
| VK1-33_14_3_9 | CCTGAAGATATTGCAACATATTACTGTCAGCAGTACNHCAATYWCCCTCCTACTTTTGGCGGAGGGACCAAG | CAGCAGTACNHCAATYWCCCTCCTACT | 1714 | 2338 |
| VK1-33_15_3_9 | CCTGAAGATATTGCAACATATTACTGTCAGCAGTACGATNHCYWCCCTCCTACTTTTGGCGGAGGGACCAAG | CAGCAGTACGATNHCYWCCCTCCTACT | 1715 | 2339 |
| VK1-33_2_3_9 | CCTGAAGATATTGCAACATATTACTGTSWMCAGBHCGATAATCTCCCTCCTACTTTTGGCGGAGGGACCAAG | SWMCAGBHCGATAATCTCCCTCCTACT | 1716 | 2340 |
| VK1-33_3_3_9 | CCTGAAGATATTGCAACATATTACTGTSWMCAGTACNHCAATCTCCCTCCTACTTTTGGCGGAGGGACCAAG | SWMCAGTACNHCAATCTCCCTCCTACT | 1717 | 2341 |
| VK1-33_4_3_9 | CCTGAAGATATTGCAACATATTACTGTSWMCAGTACGATNHCCTCCCTCCTACTTTTGGCGGAGGGACCAAG | SWMCAGTACGATNHCCTCCCTCCTACT | 1718 | 2342 |
| VK1-33_5_3_9 | CCTGAAGATATTGCAACATATTACTGTSWMCAGTACGATAATYWCCCTCCTACTTTTGGCGGAGGGACCAAG | SWMCAGTACGATAATYWCCCTCCTACT | 1719 | 2343 |
| VK1-33_6_3_9 | CCTGAAGATATTGCAACATATTACTGTCAGSWMBHCGATAATCTCCCTCCTACTTTTGGCGGAGGGACCAAG | CAGSWMBHCGATAATCTCCCTCCTACT | 1720 | 2344 |
| VK1-33_7_3_9 | CCTGAAGATATTGCAACATATTACTGTCAGSWMTACNHCAATCTCCCTCCTACTTTTGGCGGAGGGACCAAG | CAGSWMTACNHCAATCTCCCTCCTACT | 1721 | 2345 |
| VK1-33_8_3_9 | CCTGAAGATATTGCAACATATTACTGTCAGSWMTACGATNHCCTCCCTCCTACTTTTGGCGGAGGGACCAAG | CAGSWMTACGATNHCCTCCCTCCTACT | 1722 | 2346 |
| VK1-33_9_3_9 | CCTGAAGATATTGCAACATATTACTGTCAGSWMTACGATAATYWCCCTCCTACTTTTGGCGGAGGGACCAAG | CAGSWMTACGATAATYWCCCTCCTACT | 1723 | 2347 |
| VK1-39_1_0_9 | CCTGAAGATTTTGCAACTTACTACTGTSWMSWMAGCTACAGTACTCCTTWCACTTTTGGCGGAGGGACCAAG | SWMSWMAGCTACAGTACTCCTTWCACT | 1724 | 305 |
| VK1-39_10_0_9 | CCTGAAGATTTTGCAACTTACTACTGTCAGCAAVNABHCAGTACTCCTTWCACTTTTGGCGGAGGGACCAAG | CAGCAAVNABHCAGTACTCCTTWCACT | 1725 | 314 |
| VK1-39_11_0_9 | CCTGAAGATTTTGCAACTTACTACTGTCAGCAAVNATACNHCACTCCTTWCACTTTTGGCGGAGGGACCAAG | CAGCAAVNATACNHCACTCCTTWCACT | 1726 | 315 |
| VK1-39_12_0_9 | CCTGAAGATTTTGCAACTTACTACTGTCAGCAAVNATACAGTBHCCCTTWCACTTTTGGCGGAGGGACCAAG | CAGCAAVNATACAGTBHCCCTTWCACT | 1727 | 316 |
| VK1-39_13_0_9 | CCTGAAGATTTTGCAACTTACTACTGTCAGCAAAGCBHCNHCACTCCTTWCACTTTTGGCGGAGGGACCAAG | CAGCAAAGCBHCNHCACTCCTTWCACT | 1728 | 317 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_14_0_9 | CCTGAAGATTTTGCAACTTACTACTGTCAGCAAAGCBHCAGTBHCCCTTWCACTTTTGGCGGAGGGACCAAG | CAGCAAAGCBHCAGTBHCCCTTWCACT | 1729 | 318 |
| VK1-39_15_0_9 | CCTGAAGATTTTGCAACTTACTACTGTCAGCAAAGCTACNHCBHCCCTTWCACTTTTGGCGGAGGGACCAAG | CAGCAAAGCTACNHCBHCCCTTWCACT | 1730 | 319 |
| VK1-39_2_0_9 | CCTGAAGATTTTGCAACTTACTACTGTSWMCAAVNATACAGTACTCCTTWCACTTTTGGCGGAGGGACCAAG | SWMCAAVNATACAGTACTCCTTWCACT | 1731 | 306 |
| VK1-39_3_0_9 | CCTGAAGATTTTGCAACTTACTACTGTSWMCAAAGCBHCAGTACTCCTTWCACTTTTGGCGGAGGGACCAAG | SWMCAAAGCBHCAGTACTCCTTWCACT | 1732 | 307 |
| VK1-39_4_0_9 | CCTGAAGATTTTGCAACTTACTACTGTSWMCAAAGCTACNHCACTCCTTWCACTTTTGGCGGAGGGACCAAG | SWMCAAAGCTACNHCACTCCTTWCACT | 1733 | 308 |
| VK1-39_5_0_9 | CCTGAAGATTTTGCAACTTACTACTGTSWMCAAAGCTACAGTBHCCCTTWCACTTTTGGCGGAGGGACCAAG | SWMCAAAGCTACAGTBHCCCTTWCACT | 1734 | 309 |
| VK1-39_6_0_9 | CCTGAAGATTTTGCAACTTACTACTGTCAGSWMVNATACAGTACTCCTTWCACTTTTGGCGGAGGGACCAAG | CAGSWMVNATACAGTACTCCTTWCACT | 1735 | 310 |
| VK1-39_7_0_9 | CCTGAAGATTTTGCAACTTACTACTGTCAGSWMAGCBHCAGTACTCCTTWCACTTTTGGCGGAGGGACCAAG | CAGSWMAGCBHCAGTACTCCTTWCACT | 1736 | 311 |
| VK1-39_8_0_9 | CCTGAAGATTTTGCAACTTACTACTGTCAGSWMAGCTACNHCACTCCTTWCACTTTTGGCGGAGGGACCAAG | CAGSWMAGCTACNHCACTCCTTWCACT | 1737 | 312 |
| VK1-39_9_0_9 | CCTGAAGATTTTGCAACTTACTACTGTCAGSWMAGCTACAGTBHCCCTTWCACTTTTGGCGGAGGGACCAAG | CAGSWMAGCTACAGTBHCCCTTWCACT | 1738 | 313 |
| VK1-39_1_1_9 | CCTGAAGATTTTGCAACTTACTACTGTSWMSWMAGCTACAGTACTCCTMTCACTTTTGGCGGAGGGACCAAG | SWMSWMAGCTACAGTACTCCTMTCACT | 1739 | 2348 |
| VK1-39_10_1_9 | CCTGAAGATTTTGCAACTTACTACTGTCAGCAAVNABHCAGTACTCCTMTCACTTTTGGCGGAGGGACCAAG | CAGCAAVNABHCAGTACTCCTMTCACT | 1740 | 2349 |
| VK1-39_11_1_9 | CCTGAAGATTTTGCAACTTACTACTGTCAGCAAVNATACNHCACTCCTMTCACTTTTGGCGGAGGGACCAAG | CAGCAAVNATACNHCACTCCTMTCACT | 1741 | 2350 |
| VK1-39_12_1_9 | CCTGAAGATTTTGCAACTTACTACTGTCAGCAAVNATACAGTBHCCCTMTCACTTTTGGCGGAGGGACCAAG | CAGCAAVNATACAGTBHCCCTMTCACT | 1742 | 2351 |
| VK1-39_13_1_9 | CCTGAAGATTTTGCAACTTACTACTGTCAGCAAAGCBHCNHCACTCCTMTCACTTTTGGCGGAGGGACCAAG | CAGCAAAGCBHCNHCACTCCTMTCACT | 1743 | 2352 |
| VK1-39_14_1_9 | CCTGAAGATTTTGCAACTTACTACTGTCAGCAAAGCBHCAGTBHCCCTMTCACTTTTGGCGGAGGGACCAAG | CAGCAAAGCBHCAGTBHCCCTMTCACT | 1744 | 2353 |
| VK1-39_15_1_9 | CCTGAAGATTTTGCAACTTACTACTGTCAGCAAAGCTACNHCBHCCCTMTCACTTTTGGCGGAGGGACCAAG | CAGCAAAGCTACNHCBHCCCTMTCACT | 1745 | 2354 |
| VK1-39_2_1_9 | CCTGAAGATTTTGCAACTTACTACTGTSWMCAAVNATACAGTACTCCTMTCACTTTTGGCGGAGGGACCAAG | SWMCAAVNATACAGTACTCCTMTCACT | 1746 | 2355 |
| VK1-39_3_1_9 | CCTGAAGATTTTGCAACTTACTACTGTSWMCAAAGCBHCAGTACTCCTMTCACTTTTGGCGGAGGGACCAAG | SWMCAAAGCBHCAGTACTCCTMTCACT | 1747 | 2356 |
| VK1-39_4_1_9 | CCTGAAGATTTTGCAACTTACTACTGTSWMCAAAGCTACNHCACTCCTMTCACTTTTGGCGGAGGGACCAAG | SWMCAAAGCTACNHCACTCCTMTCACT | 1748 | 2357 |
| VK1-39_5_1_9 | CCTGAAGATTTTGCAACTTACTACTGTSWMCAAAGCTACAGTBHCCCTMTCACTTTTGGCGGAGGGACCAAG | SWMCAAAGCTACAGTBHCCCTMTCACT | 1749 | 2358 |
| VK1-39_6_1_9 | CCTGAAGATTTTGCAACTTACTACTGTCAGSWMVNATACAGTACTCCTMTCACTTTTGGCGGAGGGACCAAG | CAGSWMVNATACAGTACTCCTMTCACT | 1750 | 2359 |
| VK1-39_7_1_9 | CCTGAAGATTTTGCAACTTACTACTGTCAGSWMAGCBHCAGTACTCCTMTCACTTTTGGCGGAGGGACCAAG | CAGSWMAGCBHCAGTACTCCTMTCACT | 1751 | 2360 |
| VK1-39_8_1_9 | CCTGAAGATTTTGCAACTTACTACTGTCAGSWMAGCTACNHCACTCCTMTCACTTTTGGCGGAGGGACCAAG | CAGSWMAGCTACNHCACTCCTMTCACT | 1752 | 2361 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK1-39_9_1_9 | CCTGAAGATTTTGCAACTTACTACTGTCAGSWMAGCTACAGTBHCCCTMTCACTTTTGGCGGAGGGACCAAG | CAGSWMAGCTACAGTBHCCCTMTCACT | 1753 | 2362 |
| VK1-39_1_2_9 | CCTGAAGATTTTGCAACTTACTACTGTSWMSWMAGCTACAGTACTCCTWGGACTTTTGGCGGAGGGACCAAG | SWMSWMAGCTACAGTACTCCTWGGACT | 1754 | 2363 |
| VK1-39_10_2_9 | CCTGAAGATTTTGCAACTTACTACTGTCAGCAAVNABHCAGTACTCCTWGGACTTTTGGCGGAGGGACCAAG | CAGCAAVNABHCAGTACTCCTWGGACT | 1755 | 2364 |
| VK1-39_11_2_9 | CCTGAAGATTTTGCAACTTACTACTGTCAGCAAVNATACNHCACTCCTWGGACTTTTGGCGGAGGGACCAAG | CAGCAAVNATACNHCACTCCTWGGACT | 1756 | 2365 |
| VK1-39_12_2_9 | CCTGAAGATTTTGCAACTTACTACTGTCAGCAAVNATACAGTBHCCCTWGGACTTTTGGCGGAGGGACCAAG | CAGCAAVNATACAGTBHCCCTWGGACT | 1757 | 2366 |
| VK1-39_13_2_9 | CCTGAAGATTTTGCAACTTACTACTGTCAGCAAAGCBHCNHCACTCCTWGGACTTTTGGCGGAGGGACCAAG | CAGCAAAGCBHCNHCACTCCTWGGACT | 1758 | 2367 |
| VK1-39_14_2_9 | CCTGAAGATTTTGCAACTTACTACTGTCAGCAAAGCBHCAGTBHCCCTWGGACTTTTGGCGGAGGGACCAAG | CAGCAAAGCBHCAGTBHCCCTWGGACT | 1759 | 2368 |
| VK1-39_15_2_9 | CCTGAAGATTTTGCAACTTACTACTGTCAGCAAAGCTACNHCBHCCCTWGGACTTTTGGCGGAGGGACCAAG | CAGCAAAGCTACNHCBHCCCTWGGACT | 1760 | 2369 |
| VK1-39_2_2_9 | CCTGAAGATTTTGCAACTTACTACTGTSWMCAAVNATACAGTACTCCTWGGACTTTTGGCGGAGGGACCAAG | SWMCAAVNATACAGTACTCCTWGGACT | 1761 | 2370 |
| VK1-39_3_2_9 | CCTGAAGATTTTGCAACTTACTACTGTSWMCAAAGCBHCAGTACTCCTWGGACTTTTGGCGGAGGGACCAAG | SWMCAAAGCBHCAGTACTCCTWGGACT | 1762 | 2371 |
| VK1-39_4_2_9 | CCTGAAGATTTTGCAACTTACTACTGTSWMCAAAGCTACNHCACTCCTWGGACTTTTGGCGGAGGGACCAAG | SWMCAAAGCTACNHCACTCCTWGGACT | 1763 | 2372 |
| VK1-39_5_2_9 | CCTGAAGATTTTGCAACTTACTACTGTSWMCAAAGCTACAGTBHCCCTWGGACTTTTGGCGGAGGGACCAAG | SWMCAAAGCTACAGTBHCCCTWGGACT | 1764 | 2373 |
| VK1-39_6_2_9 | CCTGAAGATTTTGCAACTTACTACTGTCAGSWMVNATACAGTACTCCTWGGACTTTTGGCGGAGGGACCAAG | CAGSWMVNATACAGTACTCCTWGGACT | 1765 | 2374 |
| VK1-39_7_2_9 | CCTGAAGATTTTGCAACTTACTACTGTCAGSWMAGCBHCAGTACTCCTWGGACTTTTGGCGGAGGGACCAAG | CAGSWMAGCBHCAGTACTCCTWGGACT | 1766 | 2375 |
| VK1-39_8_2_9 | CCTGAAGATTTTGCAACTTACTACTGTCAGSWMAGCTACNHCACTCCTWGGACTTTTGGCGGAGGGACCAAG | CAGSWMAGCTACNHCACTCCTWGGACT | 1767 | 2376 |
| VK1-39_9_2_9 | CCTGAAGATTTTGCAACTTACTACTGTCAGSWMAGCTACAGTBHCCCTWGGACTTTTGGCGGAGGGACCAAG | CAGSWMAGCTACAGTBHCCCTWGGACT | 1768 | 2377 |
| VK1-39_1_3_9 | CCTGAAGATTTTGCAACTTACTACTGTSWMSWMAGCTACAGTACTCCTCCTACTTTTGGCGGAGGGACCAAG | SWMSWMAGCTACAGTACTCCTCCTACT | 1769 | 2378 |
| VK1-39_10_3_9 | CCTGAAGATTTTGCAACTTACTACTGTCAGCAAVNABHCAGTACTCCTCCTACTTTTGGCGGAGGGACCAAG | CAGCAAVNABHCAGTACTCCTCCTACT | 1770 | 2379 |
| VK1-39_11_3_9 | CCTGAAGATTTTGCAACTTACTACTGTCAGCAAVNATACNHCACTCCTCCTACTTTTGGCGGAGGGACCAAG | CAGCAAVNATACNHCACTCCTCCTACT | 1771 | 2380 |
| VK1-39_12_3_9 | CCTGAAGATTTTGCAACTTACTACTGTCAGCAAVNATACAGTBHCCCTCCTACTTTTGGCGGAGGGACCAAG | CAGCAAVNATACAGTBHCCCTCCTACT | 1772 | 2381 |
| VK1-39_13_3_9 | CCTGAAGATTTTGCAACTTACTACTGTCAGCAAAGCBHCNHCACTCCTCCTACTTTTGGCGGAGGGACCAAG | CAGCAAAGCBHCNHCACTCCTCCTACT | 1773 | 2382 |
| VK1-39_14_3_9 | CCTGAAGATTTTGCAACTTACTACTGTCAGCAAAGCBHCAGTBHCCCTCCTACTTTTGGCGGAGGGACCAAG | CAGCAAAGCBHCAGTBHCCCTCCTACT | 1774 | 2383 |
| VK1-39_15_3_9 | CCTGAAGATTTTGCAACTTACTACTGTCAGCAAAGCTACNHCBHCCCTCCTACTTTTGGCGGAGGGACCAAG | CAGCAAAGCTACNHCBHCCCTCCTACT | 1775 | 2384 |
| VK1-39_2_3_9 | CCTGAAGATTTTGCAACTTACTACTGTSWMCAAVNATACAGTACTCCTCCTACTTTTGGCGGAGGGACCAAG | SWMCAAVNATACAGTACTCCTCCTACT | 1776 | 2385 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_3_3_9 | CCTGAAGATTTTGCAACTTACTACTGTSWMCAAAGCBHCAGTACTCCTCCTACTTTTGGCGGAGGGACCAAG | SWMCAAAGCBHCAGTACTCCTCTACT | 1777 | 2386 |
| VK1-39_4_3_9 | CCTGAAGATTTTGCAACTTACTACTGTSWMCAAAGCTACNHCACTCCTCCTACTTTTGGCGGAGGGACCAAG | SWMCAAAGCTACNHCACTCCTCTACT | 1778 | 2387 |
| VK1-39_5_3_9 | CCTGAAGATTTTGCAACTTACTACTGTSWMCAAAGCTACAGTBHCCCTCCTACTTTTGGCGGAGGGACCAAG | SWMCAAAGCTACAGTBHCCCTCTACT | 1779 | 2388 |
| VK1-39_6_3_9 | CCTGAAGATTTTGCAACTTACTACTGTCAGSWMVNATACAGTACTCCTCCTACTTTTGGCGGAGGGACCAAG | CAGSWMVNATACAGTACTCCTCTACT | 1780 | 2389 |
| VK1-39_7_3_9 | CCTGAAGATTTTGCAACTTACTACTGTCAGSWMAGCBHCAGTACTCCTCCTACTTTTGGCGGAGGGACCAAG | CAGSWMAGCBHCAGTACTCCTCTACT | 1781 | 2390 |
| VK1-39_8_3_9 | CCTGAAGATTTTGCAACTTACTACTGTCAGSWMAGCTACNHCACTCCTCCTACTTTTGGCGGAGGGACCAAG | CAGSWMAGCTACNHCACTCCTCTACT | 1782 | 2391 |
| VK1-39_9_3_9 | CCTGAAGATTTTGCAACTTACTACTGTCAGSWMAGCTACAGTBHCCCTCCTACTTTTGGCGGAGGGACCAAG | CAGSWMAGCTACAGTBHCCCTCTACT | 1783 | 2392 |
| VK2-28_1_0_9 | GCTGAGGATGTTGGGGTTTATTACTGCDTSSWMGCACTCCAGACTCCTTWCACTTTTGGCGGAGGGACCAAG | DTSSWMGCACTCCAGACTCCTTWCACT | 1784 | 2393 |
| VK2-28_10_0_9 | GCTGAGGATGTTGGGGTTTATTACTGCATGCAGVNAMNACAGACTCCTTWCACTTTTGGCGGAGGGACCAAG | ATGCAGVNAMNACAGACTCCTTWCACT | 1785 | 2394 |
| VK2-28_11_0_9 | GCTGAGGATGTTGGGGTTTATTACTGCATGCAGVNACTCSRMACTCCTTWCACTTTTGGCGGAGGGACCAAG | ATGCAGVNACTCSRMACTCCTTWCACT | 1786 | 2395 |
| VK2-28_12_0_9 | GCTGAGGATGTTGGGGTTTATTACTGCATGCAGVNACTCCAGVBCCCTTWCACTTTTGGCGGAGGGACCAAG | ATGCAGVNACTCCAGVBCCCTTWCACT | 1787 | 2396 |
| VK2-28_13_0_9 | GCTGAGGATGTTGGGGTTTATTACTGCATGCAGGCAMNASRMACTCCTTWCACTTTTGGCGGAGGGACCAAG | ATGCAGGCAMNASRMACTCCTTWCACT | 1788 | 2397 |
| VK2-28_14_0_9 | GCTGAGGATGTTGGGGTTTATTACTGCATGCAGGCAMNACAGVBCCCTTWCACTTTTGGCGGAGGGACCAAG | ATGCAGGCAMNACAGVBCCCTTWCACT | 1789 | 2398 |
| VK2-28_15_0_9 | GCTGAGGATGTTGGGGTTTATTACTGCATGCAGGCACTCSRMVBCCCTTWCACTTTTGGCGGAGGGACCAAG | ATGCAGGCACTCSRMVBCCCTTWCACT | 1790 | 2399 |
| VK2-28_2_0_9 | GCTGAGGATGTTGGGGTTTATTACTGCDTSCAGVNACTCCAGACTCCTTWCACTTTTGGCGGAGGGACCAAG | DTSCAGVNACTCCAGACTCCTTWCACT | 1791 | 2400 |
| VK2-28_3_0_9 | GCTGAGGATGTTGGGGTTTATTACTGCDTSCAGGCAMNACAGACTCCTTWCACTTTTGGCGGAGGGACCAAG | DTSCAGGCAMNACAGACTCCTTWCACT | 1792 | 2401 |
| VK2-28_4_0_9 | GCTGAGGATGTTGGGGTTTATTACTGCDTSCAGGCACTCSRMACTCCTTWCACTTTTGGCGGAGGGACCAAG | DTSCAGGCACTCSRMACTCCTTWCACT | 1793 | 2402 |
| VK2-28_5_0_9 | GCTGAGGATGTTGGGGTTTATTACTGCDTSCAGGCACTCCAGVBCCCTTWCACTTTTGGCGGAGGGACCAAG | DTSCAGGCACTCCAGVBCCCTTWCACT | 1794 | 2403 |
| VK2-28_6_0_9 | GCTGAGGATGTTGGGGTTTATTACTGCATGSWMVNACTCCAGACTCCTTWCACTTTTGGCGGAGGGACCAAG | ATGSWMVNACTCCAGACTCCTTWCACT | 1795 | 2404 |
| VK2-28_7_0_9 | GCTGAGGATGTTGGGGTTTATTACTGCATGSWMGCAMNACAGACTCCTTWCACTTTTGGCGGAGGGACCAAG | ATGSWMGCAMNACAGACTCCTTWCACT | 1796 | 2405 |
| VK2-28_8_0_9 | GCTGAGGATGTTGGGGTTTATTACTGCATGSWMGCACTCSRMACTCCTTWCACTTTTGGCGGAGGGACCAAG | ATGSWMGCACTCSRMACTCCTTWCACT | 1797 | 2406 |
| VK2-28_9_0_9 | GCTGAGGATGTTGGGGTTTATTACTGCATGSWMGCACTCCAGVBCCCTTWCACTTTTGGCGGAGGGACCAAG | ATGSWMGCACTCCAGVBCCCTTWCACT | 1798 | 2407 |
| VK2-28_1_1_9 | GCTGAGGATGTTGGGGTTTATTACTGCDTSSWMGCACTCCAGACTCCTMCACTTTTGGCGGAGGGACCAAG | DTSSWMGCACTCCAGACTCCTMTCACT | 1799 | 2408 |
| VK2-28_10_1_9 | GCTGAGGATGTTGGGGTTTATTACTGCATGCAGVNAMNACAGACTCCTMCACTTTTGGCGGAGGGACCAAG | ATGCAGVNAMNACAGACTCCTMTCACT | 1800 | 2409 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_11_1_9 | GCTGAGGATGTTGGGGTTTATTACTGCATGCAGVNACTCSRMACTCCTMTCACTTTTGGCGGAGGGACCAAG | ATGCAGVNACTCSRMACTCCTMTCACT | 1801 | 2410 |
| VK2-28_12_1_9 | GCTGAGGATGTTGGGGTTTATTACTGCATGCAGVNACTCCAGVBCCCTMTCACTTTTGGCGGAGGGACCAAG | ATGCAGVNACTCCAGVBCCCTMTCACT | 1802 | 2411 |
| VK2-28_13_1_9 | GCTGAGGATGTTGGGGTTTATTACTGCATGCAGGCAMNASRMACTCCTMTCACTTTTGGCGGAGGGACCAAG | ATGCAGGCAMNASRMACTCCTMTCACT | 1803 | 2412 |
| VK2-28_14_1_9 | GCTGAGGATGTTGGGGTTTATTACTGCATGCAGGCAMNACAGVBCCCTMTCACTTTTGGCGGAGGGACCAAG | ATGCAGGCAMNACAGVBCCCTMTCACT | 1804 | 2413 |
| VK2-28_15_1_9 | GCTGAGGATGTTGGGGTTTATTACTGCATGCAGGCACTCSRMVBCCCTMTCACTTTTGGCGGAGGGACCAAG | ATGCAGGCACTCSRMVBCCCTMTCACT | 1805 | 2414 |
| VK2-28_2_1_9 | GCTGAGGATGTTGGGGTTTATTACTGCDTSCAGVNACTCCAGACTCCTMTCACTTTTGGCGGAGGGACCAAG | DTSCAGVNACTCCAGACTCCTMTCACT | 1806 | 2415 |
| VK2-28_3_1_9 | GCTGAGGATGTTGGGGTTTATTACTGCDTSCAGGCAMNACAGACTCCTMTCACTTTTGGCGGAGGGACCAAG | DTSCAGGCAMNACAGACTCCTMTCACT | 1807 | 2416 |
| VK2-28_4_1_9 | GCTGAGGATGTTGGGGTTTATTACTGCDTSCAGGCACTCSRMACTCCTMTCACTTTTGGCGGAGGGACCAAG | DTSCAGGCACTCSRMACTCCTMTCACT | 1808 | 2417 |
| VK2-28_5_1_9 | GCTGAGGATGTTGGGGTTTATTACTGCDTSCAGGCACTCCAGVBCCCTMTCACTTTTGGCGGAGGGACCAAG | DTSCAGGCACTCCAGVBCCCTMTCACT | 1809 | 2418 |
| VK2-28_6_1_9 | GCTGAGGATGTTGGGGTTTATTACTGCATGSWMVNACTCCAGACTCCTMTCACTTTTGGCGGAGGGACCAAG | ATGSWMVNACTCCAGACTCCTMTCACT | 1810 | 2419 |
| VK2-28_7_1_9 | GCTGAGGATGTTGGGGTTTATTACTGCATGSWMGCAMNACAGACTCCTMTCACTTTTGGCGGAGGGACCAAG | ATGSWMGCAMNACAGACTCCTMTCACT | 1811 | 2420 |
| VK2-28_8_1_9 | GCTGAGGATGTTGGGGTTTATTACTGCATGSWMGCACTCSRMACTCCTMTCACTTTTGGCGGAGGGACCAAG | ATGSWMGCACTCSRMACTCCTMTCACT | 1812 | 2421 |
| VK2-28_9_1_9 | GCTGAGGATGTTGGGGTTTATTACTGCATGSWMGCACTCCAGVBCCCTMTCACTTTTGGCGGAGGGACCAAG | ATGSWMGCACTCCAGVBCCCTMTCACT | 1813 | 2422 |
| VK2-28_1_2_9 | GCTGAGGATGTTGGGGTTTATTACTGCDTSSWMGCACTCCAGACTCCTWGGACTTTTGGCGGAGGGACCAAG | DTSSWMGCACTCCAGACTCCTWGGACT | 1814 | 2423 |
| VK2-28_10_2_9 | GCTGAGGATGTTGGGGTTTATTACTGCATGCAGVNAMNACAGACTCCTWGGACTTTTGGCGGAGGGACCAAG | ATGCAGVNAMNACAGACTCCTWGGACT | 1815 | 2424 |
| VK2-28_11_2_9 | GCTGAGGATGTTGGGGTTTATTACTGCATGCAGVNACTCSRMACTCCTWGGACTTTTGGCGGAGGGACCAAG | ATGCAGVNACTCSRMACTCCTWGGACT | 1816 | 2425 |
| VK2-28_12_2_9 | GCTGAGGATGTTGGGGTTTATTACTGCATGCAGVNACTCCAGVBCCCTWGGACTTTTGGCGGAGGGACCAAG | ATGCAGVNACTCCAGVBCCCTWGGACT | 1817 | 2426 |
| VK2-28_13_2_9 | GCTGAGGATGTTGGGGTTTATTACTGCATGCAGGCAMNASRMACTCCTWGGACTTTTGGCGGAGGGACCAAG | ATGCAGGCAMNASRMACTCCTWGGACT | 1818 | 2427 |
| VK2-28_14_2_9 | GCTGAGGATGTTGGGGTTTATTACTGCATGCAGGCAMNACAGVBCCCTWGGACTTTTGGCGGAGGGACCAAG | ATGCAGGCAMNACAGVBCCCTWGGACT | 1819 | 2428 |
| VK2-28_15_2_9 | GCTGAGGATGTTGGGGTTTATTACTGCATGCAGGCACTCSRMVBCCCTWGGACTTTTGGCGGAGGGACCAAG | ATGCAGGCACTCSRMVBCCCTWGGACT | 1820 | 2429 |
| VK2-28_2_2_9 | GCTGAGGATGTTGGGGTTTATTACTGCDTSCAGVNACTCCAGACTCCTWGGACTTTTGGCGGAGGGACCAAG | DTSCAGVNACTCCAGACTCCTWGGACT | 1821 | 2430 |
| VK2-28_3_2_9 | GCTGAGGATGTTGGGGTTTATTACTGCDTSCAGGCAMNACAGACTCCTWGGACTTTTGGCGGAGGGACCAAG | DTSCAGGCAMNACAGACTCCTWGGACT | 1822 | 2431 |
| VK2-28_4_2_9 | GCTGAGGATGTTGGGGTTTATTACTGCDTSCAGGCACTCSRMACTCCTWGGACTTTTGGCGGAGGGACCAAG | DTSCAGGCACTCSRMACTCCTWGGACT | 1823 | 2432 |
| VK2-28_5_2_9 | GCTGAGGATGTTGGGGTTTATTACTGCDTSCAGGCACTCCAGVBCCCTWGGACTTTTGGCGGAGGGACCAAG | DTSCAGGCACTCCAGVBCCCTWGGACT | 1824 | 2433 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_6_2_9 | GCTGAGGATGTTGGGGTTTATTACTGCATGSWMVNACTCCAGACTCCTWGGACTTTTGGCGGAGGGACCAAG | ATGSWMVNACTCCAGACTCCTWGGACT | 1825 | 2434 |
| VK2-28_7_2_9 | GCTGAGGATGTTGGGGTTTATTACTGCATGSWMGCAMNACAGACTCCTWGGACTTTTGGCGGAGGGACCAAG | ATGSWMGCAMNACAGACTCCTWGGACT | 1826 | 2435 |
| VK2-28_8_2_9 | GCTGAGGATGTTGGGGTTTATTACTGCATGSWMGCACTCSRMACTCCTWGGACTTTTGGCGGAGGGACCAAG | ATGSWMGCACTCSRMACTCCTWGGACT | 1827 | 2436 |
| VK2-28_9_2_9 | GCTGAGGATGTTGGGGTTTATTACTGCATGSWMGCACTCCAGVBCCCTWGGACTTTTGGCGGAGGGACCAAG | ATGSWMGCACTCCAGVBCCCTWGGACT | 1828 | 2437 |
| VK2-28_1_3_9 | GCTGAGGATGTTGGGGTTTATTACTGCDTSSWMGCACTCCAGACTCCTCCTACTTTTGGCGGAGGGACCAAG | DTSSWMGCACTCCAGACTCCTCCTACT | 1829 | 2438 |
| VK2-28_10_3_9 | GCTGAGGATGTTGGGGTTTATTACTGCATGCAGVNAMNACAGACTCCTCCTACTTTTGGCGGAGGGACCAAG | ATGCAGVNAMNACAGACTCCTCCTACT | 1830 | 2439 |
| VK2-28_11_3_9 | GCTGAGGATGTTGGGGTTTATTACTGCATGCAGVNACTCSRMACTCCTCCTACTTTTGGCGGAGGGACCAAG | ATGCAGVNACTCSRMACTCCTCCTACT | 1831 | 2440 |
| VK2-28_12_3_9 | GCTGAGGATGTTGGGGTTTATTACTGCATGCAGVNACTCCAGVBCCCTCCTACTTTTGGCGGAGGGACCAAG | ATGCAGVNACTCCAGVBCCCTCCTACT | 1832 | 2441 |
| VK2-28_13_3_9 | GCTGAGGATGTTGGGGTTTATTACTGCATGCAGGCAMNASRMACTCCTCCTACTTTTGGCGGAGGGACCAAG | ATGCAGGCAMNASRMACTCCTCCTACT | 1833 | 2442 |
| VK2-28_14_3_9 | GCTGAGGATGTTGGGGTTTATTACTGCATGCAGGCAMNACAGVBCCCTCCTACTTTTGGCGGAGGGACCAAG | ATGCAGGCAMNACAGVBCCCTCCTACT | 1834 | 2443 |
| VK2-28_15_3_9 | GCTGAGGATGTTGGGGTTTATTACTGCATGCAGGCACTCSRMVBCCCTCCTACTTTTGGCGGAGGGACCAAG | ATGCAGGCACTCSRMVBCCCTCCTACT | 1835 | 2444 |
| VK2-28_2_3_9 | GCTGAGGATGTTGGGGTTTATTACTGCDTSCAGVNACTCCAGACTCCTCCTACTTTTGGCGGAGGGACCAAG | DTSCAGVNACTCCAGACTCCTCCTACT | 1836 | 2445 |
| VK2-28_3_3_9 | GCTGAGGATGTTGGGGTTTATTACTGCDTSCAGGCAMNACAGACTCCTCCTACTTTTGGCGGAGGGACCAAG | DTSCAGGCAMNACAGACTCCTCCTACT | 1837 | 2446 |
| VK2-28_4_3_9 | GCTGAGGATGTTGGGGTTTATTACTGCDTSCAGGCACTCSRMACTCCTCCTACTTTTGGCGGAGGGACCAAG | DTSCAGGCACTCSRMACTCCTCCTACT | 1838 | 2447 |
| VK2-28_5_3_9 | GCTGAGGATGTTGGGGTTTATTACTGCDTSCAGGCACTCCAGVBCCCTCCTACTTTTGGCGGAGGGACCAAG | DTSCAGGCACTCCAGVBCCCTCCTACT | 1839 | 2448 |
| VK2-28_6_3_9 | GCTGAGGATGTTGGGGTTTATTACTGCATGSWMVNACTCCAGACTCCTCCTACTTTTGGCGGAGGGACCAAG | ATGSWMVNACTCCAGACTCCTCCTACT | 1840 | 2449 |
| VK2-28_7_3_9 | GCTGAGGATGTTGGGGTTTATTACTGCATGSWMGCAMNACAGACTCCTCCTACTTTTGGCGGAGGGACCAAG | ATGSWMGCAMNACAGACTCCTCCTACT | 1841 | 2450 |
| VK2-28_8_3_9 | GCTGAGGATGTTGGGGTTTATTACTGCATGSWMGCACTCSRMACTCCTCCTACTTTTGGCGGAGGGACCAAG | ATGSWMGCACTCSRMACTCCTCCTACT | 1842 | 2451 |
| VK2-28_9_3_9 | GCTGAGGATGTTGGGGTTTATTACTGCATGSWMGCACTCCAGVBCCCTCCTACTTTTGGCGGAGGGACCAAG | ATGSWMGCACTCCAGVBCCCTCCTACT | 1843 | 2452 |
| VK3-11_1_0_9 | CCTGAAGATTTTGCAGTTTATTACTGTSWMSWMAGAAGTAATTGGCCTTWCACTTTTGGCGGAGGGACCAAG | SWMSWMAGAAGTAATTGGCCTTWCACT | 1844 | 2453 |
| VK3-11_10_0_9 | CCTGAAGATTTTGCAGTTTATTACTGTCAGCAGBHCNHCAATTGGCCTTWCACTTTTGGCGGAGGGACCAAG | CAGCAGBHCNHCAATTGGCCTTWCACT | 1845 | 2454 |
| VK3-11_11_0_9 | CCTGAAGATTTTGCAGTTTATTACTGTCAGCAGBHCAGTNHCTGGCCTTWCACTTTTGGCGGAGGGACCAAG | CAGCAGBHCAGTNHCTGGCCTTWCACT | 1846 | 2455 |
| VK3-11_12_0_9 | CCTGAAGATTTTGCAGTTTATTACTGTCAGCAGBHCAGTAATYWCCCTTWCACTTTTGGCGGAGGGACCAAG | CAGCAGBHCAGTAATYWCCCTTWCACT | 1847 | 2456 |
| VK3-11_13_0_9 | CCTGAAGATTTTGCAGTTTATTACTGTCAGCAGAGANHCNHCTGGCCTTWCACTTTTGGCGGAGGGACCAAG | CAGCAGAGANHCNHCTGGCCTTWCACT | 1848 | 2457 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK3-11_14_0_9 | CCTGAAGATTTTGCAGTTTATTACTGTCAGCAGAGANHCAATYWCCCTTWCACTTTTGGCGGAGGGACCAAG | CAGCAGAGANHCAATYWCCCTTWCACT | 1849 | 2458 |
| VK3-11_15_0_9 | CCTGAAGATTTTGCAGTTTATTACTGTCAGCAGAGAAGTNHCYWCCCTTWCACTTTTGGCGGAGGGACCAAG | CAGCAGAGAAGTNHCYWCCCTTWCACT | 1850 | 2459 |
| VK3-11_2_0_9 | CCTGAAGATTTTGCAGTTTATTACTGTSWMCAGBHCAGTAATTGGCCTTWCACTTTTGGCGGAGGGACCAAG | SWMCAGBHCAGTAATTGGCCTTWCACT | 1851 | 2460 |
| VK3-11_3_0_9 | CCTGAAGATTTTGCAGTTTATTACTGTSWMCAGAGANHCAATTGGCCTTWCACTTTTGGCGGAGGGACCAAG | SWMCAGAGANHCAATTGGCCTTWCACT | 1852 | 2461 |
| VK3-11_4_0_9 | CCTGAAGATTTTGCAGTTTATTACTGTSWMCAGAGAAGTNHCTGGCCTTWCACTTTTGGCGGAGGGACCAAG | SWMCAGAGAAGTNHCTGGCCTTWCACT | 1853 | 2462 |
| VK3-11_5_0_9 | CCTGAAGATTTTGCAGTTTATTACTGTSWMCAGAGAAGTAATYWCCCTTWCACTTTTGGCGGAGGGACCAAG | SWMCAGAGAAGTAATYWCCCTTWCACT | 1854 | 2463 |
| VK3-11_6_0_9 | CCTGAAGATTTTGCAGTTTATTACTGTCAGSWMBHCAGTAATTGGCCTTWCACTTTTGGCGGAGGGACCAAG | CAGSWMBHCAGTAATTGGCCTTWCACT | 1855 | 2464 |
| VK3-11_7_0_9 | CCTGAAGATTTTGCAGTTTATTACTGTCAGSWMAGANHCAATTGGCCTTWCACTTTTGGCGGAGGGACCAAG | CAGSWMAGANHCAATTGGCCTTWCACT | 1856 | 2465 |
| VK3-11_8_0_9 | CCTGAAGATTTTGCAGTTTATTACTGTCAGSWMAGAAGTNHCTGGCCTTWCACTTTTGGCGGAGGGACCAAG | CAGSWMAGAAGTNHCTGGCCTTWCACT | 1857 | 2466 |
| VK3-11_9_0_9 | CCTGAAGATTTTGCAGTTTATTACTGTCAGSWMAGAAGTAATYWCCCTTWCACTTTTGGCGGAGGGACCAAG | CAGSWMAGAAGTAATYWCCCTTWCACT | 1858 | 2467 |
| VK3-11_1_1_9 | CCTGAAGATTTTGCAGTTTATTACTGTSWMSWMAGAAGTAATTGGCCTMTCACTTTTGGCGGAGGGACCAAG | SWMSWMAGAAGTAATTGGCCTMTCACT | 1859 | 2468 |
| VK3-11_10_1_9 | CCTGAAGATTTTGCAGTTTATTACTGTCAGCAGBHCNHCAATTGGCCTMTCACTTTTGGCGGAGGGACCAAG | CAGCAGBHCNHCAATTGGCCTMTCACT | 1860 | 2469 |
| VK3-11_11_1_9 | CCTGAAGATTTTGCAGTTTATTACTGTCAGCAGBHCAGTNHCTGGCCTMTCACTTTTGGCGGAGGGACCAAG | CAGCAGBHCAGTNHCTGGCCTMTCACT | 1861 | 2470 |
| VK3-11_12_1_9 | CCTGAAGATTTTGCAGTTTATTACTGTCAGCAGBHCAGTAATYWCCCTMTCACTTTTGGCGGAGGGACCAAG | CAGCAGBHCAGTAATYWCCCTMTCACT | 1862 | 2471 |
| VK3-11_13_1_9 | CCTGAAGATTTTGCAGTTTATTACTGTCAGCAGAGANHCNHCTGGCCTMTCACTTTTGGCGGAGGGACCAAG | CAGCAGAGANHCNHCTGGCCTMTCACT | 1863 | 2472 |
| VK3-11_14_1_9 | CCTGAAGATTTTGCAGTTTATTACTGTCAGCAGAGANHCAATYWCCCTMTCACTTTTGGCGGAGGGACCAAG | CAGCAGAGANHCAATYWCCCTMTCACT | 1864 | 2473 |
| VK3-11_15_1_9 | CCTGAAGATTTTGCAGTTTATTACTGTCAGCAGAGAAGTNHCYWCCCTMTCACTTTTGGCGGAGGGACCAAG | CAGCAGAGAAGTNHCYWCCCTMTCACT | 1865 | 2474 |
| VK3-11_2_1_9 | CCTGAAGATTTTGCAGTTTATTACTGTSWMCAGBHCAGTAATTGGCCTMTCACTTTTGGCGGAGGGACCAAG | SWMCAGBHCAGTAATTGGCCTMTCACT | 1866 | 2475 |
| VK3-11_3_1_9 | CCTGAAGATTTTGCAGTTTATTACTGTSWMCAGAGANHCAATTGGCCTMTCACTTTTGGCGGAGGGACCAAG | SWMCAGAGANHCAATTGGCCTMTCACT | 1867 | 2476 |
| VK3-11_4_1_9 | CCTGAAGATTTTGCAGTTTATTACTGTSWMCAGAGAAGTNHCTGGCCTMTCACTTTTGGCGGAGGGACCAAG | SWMCAGAGAAGTNHCTGGCCTMTCACT | 1868 | 2477 |
| VK3-11_5_1_9 | CCTGAAGATTTTGCAGTTTATTACTGTSWMCAGAGAAGTAATYWCCCTMTCACTTTTGGCGGAGGGACCAAG | SWMCAGAGAAGTAATYWCCCTMTCACT | 1869 | 2478 |
| VK3-11_6_1_9 | CCTGAAGATTTTGCAGTTTATTACTGTCAGSWMBHCAGTAATTGGCCTMTCACTTTTGGCGGAGGGACCAAG | CAGSWMBHCAGTAATTGGCCTMTCACT | 1870 | 2479 |
| VK3-11_7_1_9 | CCTGAAGATTTTGCAGTTTATTACTGTCAGSWMAGANHCAATTGGCCTMTCACTTTTGGCGGAGGGACCAAG | CAGSWMAGANHCAATTGGCCTMTCACT | 1871 | 2480 |
| VK3-11_8_1_9 | CCTGAAGATTTTGCAGTTTATTACTGTCAGSWMAGAAGTNHCTGGCCTMTCACTTTTGGCGGAGGGACCAAG | CAGSWMAGAAGTNHCTGGCCTMTCACT | 1872 | 2481 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_9_1_9 | CCTGAAGATTTTGCAGTTTATTACTGTCAGSWMAGAAGTAATYWCCCTMTCACTTTTGGCGGAGGGACCAAG | CAGSWMAGAAGTAATYWCCCTMTCACT | 1873 | 2482 |
| VK3-11_1_2_9 | CCTGAAGATTTTGCAGTTTATTACTGTSWMSWMAGAAGTAATTGGCCTWGGACTTTTGGCGGAGGGACCAAG | SWMSWMAGAAGTAATTGGCCTWGGACT | 1874 | 2483 |
| VK3-11_10_2_9 | CCTGAAGATTTTGCAGTTTATTACTGTCAGCAGBHCNHCAATTGGCCTWGGACTTTTGGCGGAGGGACCAAG | CAGCAGBHCNHCAATTGGCCTWGGACT | 1875 | 2484 |
| VK3-11_11_2_9 | CCTGAAGATTTTGCAGTTTATTACTGTCAGCAGBHCAGTNHCTGGCCTWGGACTTTTGGCGGAGGGACCAAG | CAGCAGBHCAGTNHCTGGCCTWGGACT | 1876 | 2485 |
| VK3-11_12_2_9 | CCTGAAGATTTTGCAGTTTATTACTGTCAGCAGBHCAGTAATYWCCCTWGGACTTTTGGCGGAGGGACCAAG | CAGCAGBHCAGTAATYWCCCTWGGACT | 1877 | 2486 |
| VK3-11_13_2_9 | CCTGAAGATTTTGCAGTTTATTACTGTCAGCAGAGANHCNHCTGGCCTWGGACTTTTGGCGGAGGGACCAAG | CAGCAGAGANHCNHCTGGCCTWGGACT | 1878 | 2487 |
| VK3-11_14_2_9 | CCTGAAGATTTTGCAGTTTATTACTGTCAGCAGAGANHCAATYWCCCTWGGACTTTTGGCGGAGGGACCAAG | CAGCAGAGANHCAATYWCCCTWGGACT | 1879 | 2488 |
| VK3-11_15_2_9 | CCTGAAGATTTTGCAGTTTATTACTGTCAGCAGAGAAGTNHCYWCCCTWGGACTTTTGGCGGAGGGACCAAG | CAGCAGAGAAGTNHCYWCCCTWGGACT | 1880 | 2489 |
| VK3-11_2_2_9 | CCTGAAGATTTTGCAGTTTATTACTGTSWMCAGBHCAGTAATTGGCCTWGGACTTTTGGCGGAGGGACCAAG | SWMCAGBHCAGTAATTGGCCTWGGACT | 1881 | 2490 |
| VK3-11_3_2_9 | CCTGAAGATTTTGCAGTTTATTACTGTSWMCAGAGANHCAATTGGCCTWGGACTTTTGGCGGAGGGACCAAG | SWMCAGAGANHCAATTGGCCTWGGACT | 1882 | 2491 |
| VK3-11_4_2_9 | CCTGAAGATTTTGCAGTTTATTACTGTSWMCAGAGAAGTNHCTGGCCTWGGACTTTTGGCGGAGGGACCAAG | SWMCAGAGAAGTNHCTGGCCTWGGACT | 1883 | 2492 |
| VK3-11_5_2_9 | CCTGAAGATTTTGCAGTTTATTACTGTSWMCAGAGAAGTAATYWCCCTWGGACTTTTGGCGGAGGGACCAAG | SWMCAGAGAAGTAATYWCCCTWGGACT | 1884 | 2493 |
| VK3-11_6_2_9 | CCTGAAGATTTTGCAGTTTATTACTGTCAGSWMBHCAGTAATTGGCCTWGGACTTTTGGCGGAGGGACCAAG | CAGSWMBHCAGTAATTGGCCTWGGACT | 1885 | 2494 |
| VK3-11_7_2_9 | CCTGAAGATTTTGCAGTTTATTACTGTCAGSWMAGANHCAATTGGCCTWGGACTTTTGGCGGAGGGACCAAG | CAGSWMAGANHCAATTGGCCTWGGACT | 1886 | 2495 |
| VK3-11_8_2_9 | CCTGAAGATTTTGCAGTTTATTACTGTCAGSWMAGAAGTNHCTGGCCTWGGACTTTTGGCGGAGGGACCAAG | CAGSWMAGAAGTNHCTGGCCTWGGACT | 1887 | 2496 |
| VK3-11_9_2_9 | CCTGAAGATTTTGCAGTTTATTACTGTCAGSWMAGAAGTAATYWCCCTWGGACTTTTGGCGGAGGGACCAAG | CAGSWMAGAAGTAATYWCCCTWGGACT | 1888 | 2497 |
| VK3-11_1_3_9 | CCTGAAGATTTTGCAGTTTATTACTGTSWMSWMAGAAGTAATTGGCCTCCTACTTTTGGCGGAGGGACCAAG | SWMSWMAGAAGTAATTGGCCTCCTACT | 1889 | 2498 |
| VK3-11_10_3_9 | CCTGAAGATTTTGCAGTTTATTACTGTCAGCAGBHCNHCAATTGGCCTCCTACTTTTGGCGGAGGGACCAAG | CAGCAGBHCNHCAATTGGCCTCCTACT | 1890 | 2499 |
| VK3-11_11_3_9 | CCTGAAGATTTTGCAGTTTATTACTGTCAGCAGBHCAGTNHCTGGCCTCCTACTTTTGGCGGAGGGACCAAG | CAGCAGBHCAGTNHCTGGCCTCCTACT | 1891 | 2500 |
| VK3-11_12_3_9 | CCTGAAGATTTTGCAGTTTATTACTGTCAGCAGBHCAGTAATYWCCCTCCTACTTTTGGCGGAGGGACCAAG | CAGCAGBHCAGTAATYWCCCTCCTACT | 1892 | 2501 |
| VK3-11_13_3_9 | CCTGAAGATTTTGCAGTTTATTACTGTCAGCAGAGANHCNHCTGGCCTCCTACTTTTGGCGGAGGGACCAAG | CAGCAGAGANHCNHCTGGCCTCCTACT | 1893 | 2502 |
| VK3-11_14_3_9 | CCTGAAGATTTTGCAGTTTATTACTGTCAGCAGAGANHCAATYWCCCTCCTACTTTTGGCGGAGGGACCAAG | CAGCAGAGANHCAATYWCCCTCCTACT | 1894 | 2503 |
| VK3-11_15_3_9 | CCTGAAGATTTTGCAGTTTATTACTGTCAGCAGAGAAGTNHCYWCCCTCCTACTTTTGGCGGAGGGACCAAG | CAGCAGAGAAGTNHCYWCCCTCCTACT | 1895 | 2504 |
| VK3-11_2_3_9 | CCTGAAGATTTTGCAGTTTATTACTGTSWMCAGBHCAGTAATTGGCCTCCTACTTTTGGCGGAGGGACCAAG | SWMCAGBHCAGTAATTGGCCTCCTACT | 1896 | 2505 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_3_3_9 | CCTGAAGATTTTGCAGTTTATTACTGTSWMCAGAGANHCAATTGGCCTCCTACTTTTGGCGGAGGGACCAAG | SWMCAGAGANHCAATTGGCCTCCTACT | 1897 | 2506 |
| VK3-11_4_3_9 | CCTGAAGATTTTGCAGTTTATTACTGTSWMCAGAGAAGTNHCTGGCCTCCTACTTTTGGCGGAGGGACCAAG | SWMCAGAGAAGTNHCTGGCCTCCTACT | 1898 | 2507 |
| VK3-11_5_3_9 | CCTGAAGATTTTGCAGTTTATTACTGTSWMCAGAGAAGTAATYWCCCTCCTACTTTTGGCGGAGGGACCAAG | SWMCAGAGAAGTAATYWCCCTCCTACT | 1899 | 2508 |
| VK3-11_6_3_9 | CCTGAAGATTTTGCAGTTTATTACTGTCAGSWMBHCAGTAATTGGCCTCCTACTTTTGGCGGAGGGACCAAG | CAGSWMBHCAGTAATTGGCCTCCTACT | 1900 | 2509 |
| VK3-11_7_3_9 | CCTGAAGATTTTGCAGTTTATTACTGTCAGSWMAGANHCAATTGGCCTCCTACTTTTGGCGGAGGGACCAAG | CAGSWMAGANHCAATTGGCCTCCTACT | 1901 | 2510 |
| VK3-11_8_3_9 | CCTGAAGATTTTGCAGTTTATTACTGTCAGSWMAGAAGTNHCTGGCCTCCTACTTTTGGCGGAGGGACCAAG | CAGSWMAGAAGTNHCTGGCCTCCTACT | 1902 | 2511 |
| VK3-11_9_3_9 | CCTGAAGATTTTGCAGTTTATTACTGTCAGSWMAGAAGTAATYWCCCTCCTACTTTTGGCGGAGGGACCAAG | CAGSWMAGAAGTAATYWCCCTCCTACT | 1903 | 2512 |
| VK3-15_1_0_9 | CAGTCTGAAGATTTTGCAGTTTATTACTGTSWMSWMTACAATAATTGGCCTTCACTTTTGGCGGAGGGACCAAG | SWMSWMTACAATAATTGGCCTTCACT | 1904 | 2513 |
| VK3-15_10_0_9 | CAGTCTGAAGATTTTGCAGTTTATTACTGTCAGCAGBHCNHCAATTGGCCTTCACTTTTGGCGGAGGGACCAAG | CAGCAGBHCNHCAATTGGCCTTCACT | 1905 | 2454 |
| VK3-15_11_0_9 | CAGTCTGAAGATTTTGCAGTTTATTACTGTCAGCAGBHCAATNHCTGGCCTTCACTTTTGGCGGAGGGACCAAG | CAGCAGBHCAATNHCTGGCCTTCACT | 1906 | 2514 |
| VK3-15_12_0_9 | CAGTCTGAAGATTTTGCAGTTTATTACTGTCAGCAGBHCAATAATYWCCCTTCACTTTTGGCGGAGGGACCAAG | CAGCAGBHCAATAATYWCCCTTCACT | 1907 | 2515 |
| VK3-15_13_0_9 | CAGTCTGAAGATTTTGCAGTTTATTACTGTCAGCAGTACNHCNHCTGGCCTTCACTTTTGGCGGAGGGACCAAG | CAGCAGTACNHCNHCTGGCCTTCACT | 1908 | 2516 |
| VK3-15_14_0_9 | CAGTCTGAAGATTTTGCAGTTTATTACTGTCAGCAGTACNHCAATYWCCCTTCACTTTTGGCGGAGGGACCAAG | CAGCAGTACNHCAATYWCCCTTCACT | 1909 | 2293 |
| VK3-15_15_0_9 | CAGTCTGAAGATTTTGCAGTTTATTACTGTCAGCAGTACAATNHCYWCCCTTCACTTTTGGCGGAGGGACCAAG | CAGCAGTACAATNHCYWCCCTTCACT | 1910 | 2517 |
| VK3-15_2_0_9 | CAGTCTGAAGATTTTGCAGTTTATTACTGTSWMCAGBHCAATAATTGGCCTTCACTTTTGGCGGAGGGACCAAG | SWMCAGBHCAATAATTGGCCTTCACT | 1911 | 2518 |
| VK3-15_3_0_9 | CAGTCTGAAGATTTTGCAGTTTATTACTGTSWMCAGTACNHCAATTGGCCTTCACTTTTGGCGGAGGGACCAAG | SWMCAGTACNHCAATTGGCCTTCACT | 1912 | 2519 |
| VK3-15_4_0_9 | CAGTCTGAAGATTTTGCAGTTTATTACTGTSWMCAGTACAATNHCTGGCCTTCACTTTTGGCGGAGGGACCAAG | SWMCAGTACAATNHCTGGCCTTCACT | 1913 | 2520 |
| VK3-15_5_0_9 | CAGTCTGAAGATTTTGCAGTTTATTACTGTSWMCAGTACAATAATYWCCCTTCACTTTTGGCGGAGGGACCAAG | SWMCAGTACAATAATYWCCCTTCACT | 1914 | 2521 |
| VK3-15_6_0_9 | CAGTCTGAAGATTTTGCAGTTTATTACTGTCAGSWMBHCAATAATTGGCCTTCACTTTTGGCGGAGGGACCAAG | CAGSWMBHCAATAATTGGCCTTCACT | 1915 | 2522 |
| VK3-15_7_0_9 | CAGTCTGAAGATTTTGCAGTTTATTACTGTCAGSWMTACNHCAATTGGCCTTCACTTTTGGCGGAGGGACCAAG | CAGSWMTACNHCAATTGGCCTTCACT | 1916 | 2523 |
| VK3-15_8_0_9 | CAGTCTGAAGATTTTGCAGTTTATTACTGTCAGSWMTACAATNHCTGGCCTTCACTTTTGGCGGAGGGACCAAG | CAGSWMTACAATNHCTGGCCTTCACT | 1917 | 2524 |
| VK3-15_9_0_9 | CAGTCTGAAGATTTTGCAGTTTATTACTGTCAGSWMTACAATAATYWCCCTTCACTTTTGGCGGAGGGACCAAG | CAGSWMTACAATAATYWCCCTTCACT | 1918 | 2525 |
| VK3-15_1_1_9 | CAGTCTGAAGATTTTGCAGTTTATTACTGTSWMSWMTACAATAATTGGCCTMTCACTTTTGGCGGAGGGACCAAG | SWMSWMTACAATAATTGGCCTMTCACT | 1919 | 2526 |
| VK3-15_10_1_9 | CAGTCTGAAGATTTTGCAGTTTATTACTGTCAGCAGBHCNHCAATTGGCCTMTCACTTTTGGCGGAGGGACCAAG | CAGCAGBHCNHCAATTGGCCTMTCACT | 1920 | 2469 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-15_11_1_9 | CAGTCTGAAGATTTTGCAGTTTATTACTGTCAGCAGBHCAATNHCTGGCCTMTCACTTTTGGCGGAGGGACCAAG | CAGCAGBHCAATNHCTGGCCTMTCACT | 1921 | 2527 |
| VK3-15_12_1_9 | CAGTCTGAAGATTTTGCAGTTTATTACTGTCAGCAGBHCAATAATYWCCCTMTCACTTTTGGCGGAGGGACCAAG | CAGCAGBHCAATAATYWCCCTMTCACT | 1922 | 2528 |
| VK3-15_13_1_9 | CAGTCTGAAGATTTTGCAGTTTATTACTGTCAGCAGTACNHCNHCTGGCCTMTCACTTTTGGCGGAGGGACCAAG | CAGCAGTACNHCNHCTGGCCTMTCACT | 1923 | 2529 |
| VK3-15_14_1_9 | CAGTCTGAAGATTTTGCAGTTTATTACTGTCAGCAGTACNHCAATYWCCCTMTCACTTTTGGCGGAGGGACCAAG | CAGCAGTACNHCAATYWCCCTMTCACT | 1924 | 2308 |
| VK3-15_15_1_9 | CAGTCTGAAGATTTTGCAGTTTATTACTGTCAGCAGTACAATNHCYWCCCTMTCACTTTTGGCGGAGGGACCAAG | CAGCAGTACAATNHCYWCCCTMTCACT | 1925 | 2530 |
| VK3-15_2_1_9 | CAGTCTGAAGATTTTGCAGTTTATTACTGTSWMCAGBHCAATAATTGGCCTMTCACTTTTGGCGGAGGGACCAAG | SWMCAGBHCAATAATTGGCCTMTCACT | 1926 | 2531 |
| VK3-15_3_1_9 | CAGTCTGAAGATTTTGCAGTTTATTACTGTSWMCAGTACNHCAATTGGCCTMTCACTTTTGGCGGAGGGACCAAG | SWMCAGTACNHCAATTGGCCTMTCACT | 1927 | 2532 |
| VK3-15_4_1_9 | CAGTCTGAAGATTTTGCAGTTTATTACTGTSWMCAGTACAATNHCTGGCCTMTCACTTTTGGCGGAGGGACCAAG | SWMCAGTACAATNHCTGGCCTMTCACT | 1928 | 2533 |
| VK3-15_5_1_9 | CAGTCTGAAGATTTTGCAGTTTATTACTGTSWMCAGTACAATAATYWCCCTMTCACTTTTGGCGGAGGGACCAAG | SWMCAGTACAATAATYWCCCTMTCACT | 1929 | 2534 |
| VK3-15_6_1_9 | CAGTCTGAAGATTTTGCAGTTTATTACTGTCAGSWMBHCAATAATTGGCCTMTCACTTTTGGCGGAGGGACCAAG | CAGSWMBHCAATAATTGGCCTMTCACT | 1930 | 2535 |
| VK3-15_7_1_9 | CAGTCTGAAGATTTTGCAGTTTATTACTGTCAGSWMTACNHCAATTGGCCTMTCACTTTTGGCGGAGGGACCAAG | CAGSWMTACNHCAATTGGCCTMTCACT | 1931 | 2536 |
| VK3-15_8_1_9 | CAGTCTGAAGATTTTGCAGTTTATTACTGTCAGSWMTACAATNHCTGGCCTMTCACTTTTGGCGGAGGGACCAAG | CAGSWMTACAATNHCTGGCCTMTCACT | 1932 | 2537 |
| VK3-15_9_1_9 | CAGTCTGAAGATTTTGCAGTTTATTACTGTCAGSWMTACAATAATYWCCCTMTCACTTTTGGCGGAGGGACCAAG | CAGSWMTACAATAATYWCCCTMTCACT | 1933 | 2538 |
| VK3-15_1_2_9 | CAGTCTGAAGATTTTGCAGTTTATTACTGTSWMSWMTACAATAATTGGCCTWGGACTTTTGGCGGAGGGACCAAG | SWMSWMTACAATAATTGGCCTWGGACT | 1934 | 2539 |
| VK3-15_10_2_9 | CAGTCTGAAGATTTTGCAGTTTATTACTGTCAGCAGBHCNHCAATTGGCCTWGGACTTTTGGCGGAGGGACCAAG | CAGCAGBHCNHCAATTGGCCTWGGACT | 1935 | 2484 |
| VK3-15_11_2_9 | CAGTCTGAAGATTTTGCAGTTTATTACTGTCAGCAGBHCAATNHCTGGCCTWGGACTTTTGGCGGAGGGACCAAG | CAGCAGBHCAATNHCTGGCCTWGGACT | 1936 | 2540 |
| VK3-15_12_2_9 | CAGTCTGAAGATTTTGCAGTTTATTACTGTCAGCAGBHCAATAATYWCCCTWGGACTTTTGGCGGAGGGACCAAG | CAGCAGBHCAATAATYWCCCTWGGACT | 1937 | 2541 |
| VK3-15_13_2_9 | CAGTCTGAAGATTTTGCAGTTTATTACTGTCAGCAGTACNHCNHCTGGCCTWGGACTTTTGGCGGAGGGACCAAG | CAGCAGTACNHCNHCTGGCCTWGGACT | 1938 | 2542 |
| VK3-15_14_2_9 | CAGTCTGAAGATTTTGCAGTTTATTACTGTCAGCAGTACNHCAATYWCCCTWGGACTTTTGGCGGAGGGACCAAG | CAGCAGTACNHCAATYWCCCTWGGACT | 1939 | 2323 |
| VK3-15_15_2_9 | CAGTCTGAAGATTTTGCAGTTTATTACTGTCAGCAGTACAATNHCYWCCCTWGGACTTTTGGCGGAGGGACCAAG | CAGCAGTACAATNHCYWCCCTWGGACT | 1940 | 2543 |
| VK3-15_2_2_9 | CAGTCTGAAGATTTTGCAGTTTATTACTGTSWMCAGBHCAATAATTGGCCTWGGACTTTTGGCGGAGGGACCAAG | SWMCAGBHCAATAATTGGCCTWGGACT | 1941 | 2544 |
| VK3-15_3_2_9 | CAGTCTGAAGATTTTGCAGTTTATTACTGTSWMCAGTACNHCAATTGGCCTWGGACTTTTGGCGGAGGGACCAAG | SWMCAGTACNHCAATTGGCCTWGGACT | 1942 | 2545 |
| VK3-15_4_2_9 | CAGTCTGAAGATTTTGCAGTTTATTACTGTSWMCAGTACAATNHCTGGCCTWGGACTTTTGGCGGAGGGACCAAG | SWMCAGTACAATNHCTGGCCTWGGACT | 1943 | 2546 |
| VK3-15_5_2_9 | CAGTCTGAAGATTTTGCAGTTTATTACTGTSWMCAGTACAATAATYWCCCTWGGACTTTTGGCGGAGGGACCAAG | SWMCAGTACAATAATYWCCCTWGGACT | 1944 | 2547 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-15_6_2_9 | CAGTCTGAAGATTTTGCAGTTTATTACTGTCAGSWMBHCAATAATTGGCCTWGGACTTTTGGCGGAGGGACCAAG | CAGSWMBHCAATAATTGGCCTWGGACT | 1945 | 2548 |
| VK3-15_7_2_9 | CAGTCTGAAGATTTTGCAGTTTATTACTGTCAGSWMTACNHCAATTGGCCTWGGACTTTTGGCGGAGGGACCAAG | CAGSWMTACNHCAATTGGCCTWGGACT | 1946 | 2549 |
| VK3-15_8_2_9 | CAGTCTGAAGATTTTGCAGTTTATTACTGTCAGSWMTACAATNHCTGGCCTWGGACTTTTGGCGGAGGGACCAAG | CAGSWMTACAATNHCTGGCCTWGGACT | 1947 | 2550 |
| VK3-15_9_2_9 | CAGTCTGAAGATTTTGCAGTTTATTACTGTCAGSWMTACAATAATYWCCCTWGGACTTTTGGCGGAGGGACCAAG | CAGSWMTACAATAATYWCCCTWGGACT | 1948 | 2551 |
| VK3-15_1_3_9 | CAGTCTGAAGATTTTGCAGTTTATTACTGTSWMSWMTACAATAATTGGCCTCCTACTTTTGGCGGAGGGACCAAG | SWMSWMTACAATAATTGGCCTCCTACT | 1949 | 2552 |
| VK3-15_10_3_9 | CAGTCTGAAGATTTTGCAGTTTATTACTGTCAGCAGBHCNHCAATTGGCCTCCTACTTTTGGCGGAGGGACCAAG | CAGCAGBHCNHCAATTGGCCTCCTACT | 1950 | 2499 |
| VK3-15_11_3_9 | CAGTCTGAAGATTTTGCAGTTTATTACTGTCAGCAGBHCAATNHCTGGCCTCCTACTTTTGGCGGAGGGACCAAG | CAGCAGBHCAATNHCTGGCCTCCTACT | 1951 | 2553 |
| VK3-15_12_3_9 | CAGTCTGAAGATTTTGCAGTTTATTACTGTCAGCAGBHCAATAATYWCCCTCCTACTTTTGGCGGAGGGACCAAG | CAGCAGBHCAATAATYWCCCTCCTACT | 1952 | 2554 |
| VK3-15_13_3_9 | CAGTCTGAAGATTTTGCAGTTTATTACTGTCAGCAGTACNHCNHCTGGCCTCCTACTTTTGGCGGAGGGACCAAG | CAGCAGTACNHCNHCTGGCCTCCTACT | 1953 | 2555 |
| VK3-15_14_3_9 | CAGTCTGAAGATTTTGCAGTTTATTACTGTCAGCAGTACNHCAATYWCCCTCCTACTTTTGGCGGAGGGACCAAG | CAGCAGTACNHCAATYWCCCTCCTACT | 1954 | 2338 |
| VK3-15_15_3_9 | CAGTCTGAAGATTTTGCAGTTTATTACTGTCAGCAGTACAATNHCYWCCCTCCTACTTTTGGCGGAGGGACCAAG | CAGCAGTACAATNHCYWCCCTCCTACT | 1955 | 2556 |
| VK3-15_2_3_9 | CAGTCTGAAGATTTTGCAGTTTATTACTGTSWMCAGBHCAATAATTGGCCTCCTACTTTTGGCGGAGGGACCAAG | SWMCAGBHCAATAATTGGCCTCCTACT | 1956 | 2557 |
| VK3-15_3_3_9 | CAGTCTGAAGATTTTGCAGTTTATTACTGTSWMCAGTACNHCAATTGGCCTCCTACTTTTGGCGGAGGGACCAAG | SWMCAGTACNHCAATTGGCCTCCTACT | 1957 | 2558 |
| VK3-15_4_3_9 | CAGTCTGAAGATTTTGCAGTTTATTACTGTSWMCAGTACAATNHCTGGCCTCCTACTTTTGGCGGAGGGACCAAG | SWMCAGTACAATNHCTGGCCTCCTACT | 1958 | 2559 |
| VK3-15_5_3_9 | CAGTCTGAAGATTTTGCAGTTTATTACTGTSWMCAGTACAATAATYWCCCTCCTACTTTTGGCGGAGGGACCAAG | SWMCAGTACAATAATYWCCCTCCTACT | 1959 | 2560 |
| VK3-15_6_3_9 | CAGTCTGAAGATTTTGCAGTTTATTACTGTCAGSWMBHCAATAATTGGCCTCCTACTTTTGGCGGAGGGACCAAG | CAGSWMBHCAATAATTGGCCTCCTACT | 1960 | 2561 |
| VK3-15_7_3_9 | CAGTCTGAAGATTTTGCAGTTTATTACTGTCAGSWMTACNHCAATTGGCCTCCTACTTTTGGCGGAGGGACCAAG | CAGSWMTACNHCAATTGGCCTCCTACT | 1961 | 2562 |
| VK3-15_8_3_9 | CAGTCTGAAGATTTTGCAGTTTATTACTGTCAGSWMTACAATNHCTGGCCTCCTACTTTTGGCGGAGGGACCAAG | CAGSWMTACAATNHCTGGCCTCCTACT | 1962 | 2563 |
| VK3-15_9_3_9 | CAGTCTGAAGATTTTGCAGTTTATTACTGTCAGSWMTACAATAATYWCCCTCCTACTTTTGGCGGAGGGACCAAG | CAGSWMTACAATAATYWCCCTCCTACT | 1963 | 2564 |
| VK3-20_1_0_9 | CCTGAAGATTTTGCAGTGTATTACTGTSWMSWMTACGGAAGTAGTCCTTWCACTTTTGGCGGAGGGACCAAG | SWMSWMTACGGAAGTAGTCCTTWCACT | 1964 | 2565 |
| VK3-20_10_0_9 | CCTGAAGATTTTGCAGTGTATTACTGTCAGCAGBHCBHCAGTAGTCCTTWCACTTTTGGCGGAGGGACCAAG | CAGCAGBHCBHCAGTAGTCCTTWCACT | 1965 | 2566 |
| VK3-20_11_0_9 | CCTGAAGATTTTGCAGTGTATTACTGTCAGCAGBHCGGAVNCAGTCCTTWCACTTTTGGCGGAGGGACCAAG | CAGCAGBHCGGAVNCAGTCCTTWCACT | 1966 | 2567 |
| VK3-20_12_0_9 | CCTGAAGATTTTGCAGTGTATTACTGTCAGCAGBHCGGAAGTBHCCCTTWCACTTTTGGCGGAGGGACCAAG | CAGCAGBHCGGAAGTBHCCCTTWCACT | 1967 | 2568 |
| VK3-20_13_0_9 | CCTGAAGATTTTGCAGTGTATTACTGTCAGCAGTACBHCVNCAGTCCTTWCACTTTTGGCGGAGGGACCAAG | CAGCAGTACBHCVNCAGTCCTTWCACT | 1968 | 2569 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_14_0_9 | CCTGAAGATTTTGCAGTGTATTACTGTCAGCAGTACBHCAGTBHCCCTTWCACTTTTGGCGGAGGGACCAAG | CAGCAGTACBHCAGTBHCCCTTWCACT | 1969 | 2570 |
| VK3-20_15_0_9 | CCTGAAGATTTTGCAGTGTATTACTGTCAGCAGTACGGAVNCBHCCCTTWCACTTTTGGCGGAGGGACCAAG | CAGCAGTACGGAVNCBHCCCTTWCACT | 1970 | 2571 |
| VK3-20_2_0_9 | CCTGAAGATTTTGCAGTGTATTACTGTSWMCAGBHCGGAAGTAGTCCTTWCACTTTTGGCGGAGGGACCAAG | SWMCAGBHCGGAAGTAGTCCTTWCACT | 1971 | 2572 |
| VK3-20_3_0_9 | CCTGAAGATTTTGCAGTGTATTACTGTSWMCAGTACBHCAGTAGTCCTTWCACTTTTGGCGGAGGGACCAAG | SWMCAGTACBHCAGTAGTCCTTWCACT | 1972 | 2573 |
| VK3-20_4_0_9 | CCTGAAGATTTTGCAGTGTATTACTGTSWMCAGTACGGAVNCAGTCCTTWCACTTTTGGCGGAGGGACCAAG | SWMCAGTACGGAVNCAGTCCTTWCACT | 1973 | 2574 |
| VK3-20_5_0_9 | CCTGAAGATTTTGCAGTGTATTACTGTSWMCAGTACGGAAGTBHCCCTTWCACTTTTGGCGGAGGGACCAAG | SWMCAGTACGGAAGTBHCCCTTWCACT | 1974 | 2575 |
| VK3-20_6_0_9 | CCTGAAGATTTTGCAGTGTATTACTGTCAGSWMBHCGGAAGTAGTCCTTWCACTTTTGGCGGAGGGACCAAG | CAGSWMBHCGGAAGTAGTCCTTWCACT | 1975 | 2576 |
| VK3-20_7_0_9 | CCTGAAGATTTTGCAGTGTATTACTGTCAGSWMTACBHCAGTAGTCCTTWCACTTTTGGCGGAGGGACCAAG | CAGSWMTACBHCAGTAGTCCTTWCACT | 1976 | 2577 |
| VK3-20_8_0_9 | CCTGAAGATTTTGCAGTGTATTACTGTCAGSWMTACGGAVNCAGTCCTTWCACTTTTGGCGGAGGGACCAAG | CAGSWMTACGGAVNCAGTCCTTWCACT | 1977 | 2578 |
| VK3-20_9_0_9 | CCTGAAGATTTTGCAGTGTATTACTGTCAGSWMTACGGAAGTBHCCCTTWCACTTTTGGCGGAGGGACCAAG | CAGSWMTACGGAAGTBHCCCTTWCACT | 1978 | 2579 |
| VK3-20_1_1_9 | CCTGAAGATTTTGCAGTGTATTACTGTSWMSWMTACGGAAGTAGTCCTMTCACTTTTGGCGGAGGGACCAAG | SWMSWMTACGGAAGTAGTCCTMTCACT | 1979 | 2580 |
| VK3-20_10_1_9 | CCTGAAGATTTTGCAGTGTATTACTGTCAGCAGBHCBHCAGTAGTCCTMTCACTTTTGGCGGAGGGACCAAG | CAGCAGBHCBHCAGTAGTCCTMTCACT | 1980 | 2581 |
| VK3-20_11_1_9 | CCTGAAGATTTTGCAGTGTATTACTGTCAGCAGBHCGGAVNCAGTCCTMTCACTTTTGGCGGAGGGACCAAG | CAGCAGBHCGGAVNCAGTCCTMTCACT | 1981 | 2582 |
| VK3-20_12_1_9 | CCTGAAGATTTTGCAGTGTATTACTGTCAGCAGBHCGGAAGTBHCCCTMTCACTTTTGGCGGAGGGACCAAG | CAGCAGBHCGGAAGTBHCCCTMTCACT | 1982 | 2583 |
| VK3-20_13_1_9 | CCTGAAGATTTTGCAGTGTATTACTGTCAGCAGTACBHCVNCAGTCCTMTCACTTTTGGCGGAGGGACCAAG | CAGCAGTACBHCVNCAGTCCTMTCACT | 1983 | 2584 |
| VK3-20_14_1_9 | CCTGAAGATTTTGCAGTGTATTACTGTCAGCAGTACBHCAGTBHCCCTMTCACTTTTGGCGGAGGGACCAAG | CAGCAGTACBHCAGTBHCCCTMTCACT | 1984 | 2585 |
| VK3-20_15_1_9 | CCTGAAGATTTTGCAGTGTATTACTGTCAGCAGTACGGAVNCBHCCCTMTCACTTTTGGCGGAGGGACCAAG | CAGCAGTACGGAVNCBHCCCTMTCACT | 1985 | 2586 |
| VK3-20_2_1_9 | CCTGAAGATTTTGCAGTGTATTACTGTSWMCAGBHCGGAAGTAGTCCTMTCACTTTTGGCGGAGGGACCAAG | SWMCAGBHCGGAAGTAGTCCTMTCACT | 1986 | 2587 |
| VK3-20_3_1_9 | CCTGAAGATTTTGCAGTGTATTACTGTSWMCAGTACBHCAGTAGTCCTMTCACTTTTGGCGGAGGGACCAAG | SWMCAGTACBHCAGTAGTCCTMTCACT | 1987 | 2588 |
| VK3-20_4_1_9 | CCTGAAGATTTTGCAGTGTATTACTGTSWMCAGTACGGAVNCAGTCCTMTCACTTTTGGCGGAGGGACCAAG | SWMCAGTACGGAVNCAGTCCTMTCACT | 1988 | 2589 |
| VK3-20_5_1_9 | CCTGAAGATTTTGCAGTGTATTACTGTSWMCAGTACGGAAGTBHCCCTMTCACTTTTGGCGGAGGGACCAAG | SWMCAGTACGGAAGTBHCCCTMTCACT | 1989 | 2590 |
| VK3-20_6_1_9 | CCTGAAGATTTTGCAGTGTATTACTGTCAGSWMBHCGGAAGTAGTCCTMTCACTTTTGGCGGAGGGACCAAG | CAGSWMBHCGGAAGTAGTCCTMTCACT | 1990 | 2591 |
| VK3-20_7_1_9 | CCTGAAGATTTTGCAGTGTATTACTGTCAGSWMTACBHCAGTAGTCCTMTCACTTTTGGCGGAGGGACCAAG | CAGSWMTACBHCAGTAGTCCTMTCACT | 1991 | 2592 |
| VK3-20_8_1_9 | CCTGAAGATTTTGCAGTGTATTACTGTCAGSWMTACGGAVNCAGTCCTMTCACTTTTGGCGGAGGGACCAAG | CAGSWMTACGGAVNCAGTCCTMTCACT | 1992 | 2593 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_9_1_9 | CCTGAAGATTTTGCAGTGTATTACTGTCAGSWMTACGGAAGTBHCCCTMTCACTTTTGGCGGAGGGACCAAG | CAGSWMTACGGAAGTBHCCCTMTCACT | 1993 | 2594 |
| VK3-20_1_2_9 | CCTGAAGATTTTGCAGTGTATTACTGTSWMSWMTACGGAAGTAGTCCTWGGACTTTTGGCGGAGGGACCAAG | SWMSWMTACGGAAGTAGTCCTWGGACT | 1994 | 2595 |
| VK3-20_10_2_9 | CCTGAAGATTTTGCAGTGTATTACTGTCAGCAGBHCBHCAGTAGTCCTWGGACTTTTGGCGGAGGGACCAAG | CAGCAGBHCBHCAGTAGTCCTWGGACT | 1995 | 2596 |
| VK3-20_11_2_9 | CCTGAAGATTTTGCAGTGTATTACTGTCAGCAGBHCGGAVNCAGTCCTWGGACTTTTGGCGGAGGGACCAAG | CAGCAGBHCGGAVNCAGTCCTWGGACT | 1996 | 2597 |
| VK3-20_12_2_9 | CCTGAAGATTTTGCAGTGTATTACTGTCAGCAGBHCGGAAGTBHCCCTWGGACTTTTGGCGGAGGGACCAAG | CAGCAGBHCGGAAGTBHCCCTWGGACT | 1997 | 2598 |
| VK3-20_13_2_9 | CCTGAAGATTTTGCAGTGTATTACTGTCAGCAGTACBHCVNCAGTCCTWGGACTTTTGGCGGAGGGACCAAG | CAGCAGTACBHCVNCAGTCCTWGGACT | 1998 | 2599 |
| VK3-20_14_2_9 | CCTGAAGATTTTGCAGTGTATTACTGTCAGCAGTACBHCAGTBHCCCTWGGACTTTTGGCGGAGGGACCAAG | CAGCAGTACBHCAGTBHCCCTWGGACT | 1999 | 2600 |
| VK3-20_15_2_9 | CCTGAAGATTTTGCAGTGTATTACTGTCAGCAGTACGGAVNCBHCCCTWGGACTTTTGGCGGAGGGACCAAG | CAGCAGTACGGAVNCBHCCCTWGGACT | 2000 | 2601 |
| VK3-20_2_2_9 | CCTGAAGATTTTGCAGTGTATTACTGTSWMCAGBHCGGAAGTAGTCCTWGGACTTTTGGCGGAGGGACCAAG | SWMCAGBHCGGAAGTAGTCCTWGGACT | 2001 | 2602 |
| VK3-20_3_2_9 | CCTGAAGATTTTGCAGTGTATTACTGTSWMCAGTACBHCAGTAGTCCTWGGACTTTTGGCGGAGGGACCAAG | SWMCAGTACBHCAGTAGTCCTWGGACT | 2002 | 2603 |
| VK3-20_4_2_9 | CCTGAAGATTTTGCAGTGTATTACTGTSWMCAGTACGGAVNCAGTCCTWGGACTTTTGGCGGAGGGACCAAG | SWMCAGTACGGAVNCAGTCCTWGGACT | 2003 | 2604 |
| VK3-20_5_2_9 | CCTGAAGATTTTGCAGTGTATTACTGTSWMCAGTACGGAAGTBHCCCTWGGACTTTTGGCGGAGGGACCAAG | SWMCAGTACGGAAGTBHCCCTWGGACT | 2004 | 2605 |
| VK3-20_6_2_9 | CCTGAAGATTTTGCAGTGTATTACTGTCAGSWMBHCGGAAGTAGTCCTWGGACTTTTGGCGGAGGGACCAAG | CAGSWMBHCGGAAGTAGTCCTWGGACT | 2005 | 2606 |
| VK3-20_7_2_9 | CCTGAAGATTTTGCAGTGTATTACTGTCAGSWMTACBHCAGTAGTCCTWGGACTTTTGGCGGAGGGACCAAG | CAGSWMTACBHCAGTAGTCCTWGGACT | 2006 | 2607 |
| VK3-20_8_2_9 | CCTGAAGATTTTGCAGTGTATTACTGTCAGSWMTACGGAVNCAGTCCTWGGACTTTTGGCGGAGGGACCAAG | CAGSWMTACGGAVNCAGTCCTWGGACT | 2007 | 2608 |
| VK3-20_9_2_9 | CCTGAAGATTTTGCAGTGTATTACTGTCAGSWMTACGGAAGTBHCCCTWGGACTTTTGGCGGAGGGACCAAG | CAGSWMTACGGAAGTBHCCCTWGGACT | 2008 | 2609 |
| VK3-20_1_3_9 | CCTGAAGATTTTGCAGTGTATTACTGTSWMSWMTACGGAAGTAGTCCTCCTACTTTTGGCGGAGGGACCAAG | SWMSWMTACGGAAGTAGTCCTCCTACT | 2009 | 2610 |
| VK3-20_10_3_9 | CCTGAAGATTTTGCAGTGTATTACTGTCAGCAGBHCBHCAGTAGTCCTCCTACTTTTGGCGGAGGGACCAAG | CAGCAGBHCBHCAGTAGTCCTCCTACT | 2010 | 2611 |
| VK3-20_11_3_9 | CCTGAAGATTTTGCAGTGTATTACTGTCAGCAGBHCGGAVNCAGTCCTCCTACTTTTGGCGGAGGGACCAAG | CAGCAGBHCGGAVNCAGTCCTCCTACT | 2011 | 2612 |
| VK3-20_12_3_9 | CCTGAAGATTTTGCAGTGTATTACTGTCAGCAGBHCGGAAGTBHCCCTCCTACTTTTGGCGGAGGGACCAAG | CAGCAGBHCGGAAGTBHCCCTCCTACT | 2012 | 2613 |
| VK3-20_13_3_9 | CCTGAAGATTTTGCAGTGTATTACTGTCAGCAGTACBHCVNCAGTCCTCCTACTTTTGGCGGAGGGACCAAG | CAGCAGTACBHCVNCAGTCCTCCTACT | 2013 | 2614 |
| VK3-20_14_3_9 | CCTGAAGATTTTGCAGTGTATTACTGTCAGCAGTACBHCAGTBHCCCTCCTACTTTTGGCGGAGGGACCAAG | CAGCAGTACBHCAGTBHCCCTCCTACT | 2014 | 2615 |
| VK3-20_15_3_9 | CCTGAAGATTTTGCAGTGTATTACTGTCAGCAGTACGGAVNCBHCCCTCCTACTTTTGGCGGAGGGACCAAG | CAGCAGTACGGAVNCBHCCCTCCTACT | 2015 | 2616 |
| VK3-20_2_3_9 | CCTGAAGATTTTGCAGTGTATTACTGTSWMCAGBHCGGAAGTAGTCCTCCTACTTTTGGCGGAGGGACCAAG | SWMCAGBHCGGAAGTAGTCCTCCTACT | 2016 | 2617 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_3_3_9 | CCTGAAGATTTTGCAGTGTATTACTGTSWMCAGTACBHCAG TAGTCCTCCTACTTTTGGCGGAGGGACCAAG | SWMCAGTACBHCAGTAGTCCTC CTACT | 2017 | 2618 |
| VK3-20_4_3_9 | CCTGAAGATTTTGCAGTGTATTACTGTSWMCAGTACGGAVN CAGTCCTCCTACTTTTGGCGGAGGGACCAAG | SWMCAGTACGGAVNCAGTCCTC CTACT | 2018 | 2619 |
| VK3-20_5_3_9 | CCTGAAGATTTTGCAGTGTATTACTGTSWMCAGTACGGAAG TBHCCCTCCTACTTTTGGCGGAGGGACCAAG | SWMCAGTACGGAAGTBHCCCTC CTACT | 2019 | 2620 |
| VK3-20_6_3_9 | CCTGAAGATTTTGCAGTGTATTACTGTCAGSWMBHCGGAAG TAGTCCTCCTACTTTTGGCGGAGGGACCAAG | CAGSWMBHCGGAAGTAGTCCTC CTACT | 2020 | 2621 |
| VK3-20_7_3_9 | CCTGAAGATTTTGCAGTGTATTACTGTCAGSWMTACBHCAG TAGTCCTCCTACTTTTGGCGGAGGGACCAAG | CAGSWMTACBHCAGTAGTCCTC CTACT | 2021 | 2622 |
| VK3-20_8_3_9 | CCTGAAGATTTTGCAGTGTATTACTGTCAGSWMTACGGAVN CAGTCCTCCTACTTTTGGCGGAGGGACCAAG | CAGSWMTACGGAVNCAGTCCTC CTACT | 2022 | 2623 |
| VK3-20_9_3_9 | CCTGAAGATTTTGCAGTGTATTACTGTCAGSWMTACGGAAG TBHCCCTCCTACTTTTGGCGGAGGGACCAAG | CAGSWMTACGGAAGTBHCCCTC CTACT | 2023 | 2624 |
| Jumping Trimer | | | | |
| VK1-05_t1_0_9 | CCTGATGATTTTGCAACTTATTACTGCCAGCAGBHCVRMMBCTAC YCTTWCACTTTTGGCGGAGGGACCAAG | CAGCAGBHCVRMMBCTACYCTTWC ACT | 2024 | 2625 |
| VK1-05_t1_1_9 | CCTGATGATTTTGCAACTTATTACTGCCAGCAGBHCVRMMBCTAC YCTMTCACTTTTGGCGGAGGGACCAAG | CAGCAGBHCVRMMBCTACYCTMTC ACT | 2025 | 2626 |
| VK1-05_t1_2_9 | CCTGATGATTTTGCAACTTATTACTGCCAGCAGBHCVRMMBCTAC YCTWGGACTTTTGGCGGAGGGACCAAG | CAGCAGBHCVRMMBCTACYCTWGG ACT | 2026 | 2627 |
| VK1-05_t1_3_9 | CCTGATGATTTTGCAACTTATTACTGCCAGCAGBHCVRMMBCTAC YCTCCTACTTTTGGCGGAGGGACCAAG | CAGCAGBHCVRMMBCTACYCTCCT ACT | 2027 | 2628 |
| VK1-05_t2_0_9 | CCTGATGATTTTGCAACTTATTACTGCCAGCAGBHCAATMBCYWC YCTTWCACTTTTGGCGGAGGGACCAAG | CAGCAGBHCAATMBCYWCYCTTWC ACT | 2028 | 2629 |
| VK1-05_t2_1_9 | CCTGATGATTTTGCAACTTATTACTGCCAGCAGBHCAATMBCYWC YCTMTCACTTTTGGCGGAGGGACCAAG | CAGCAGBHCAATMBCYWCYCTMTC ACT | 2029 | 2630 |
| VK1-05_t2_2_9 | CCTGATGATTTTGCAACTTATTACTGCCAGCAGBHCAATMBCYWC YCTWGGACTTTTGGCGGAGGGACCAAG | CAGCAGBHCAATMBCYWCYCTWGG ACT | 2030 | 2631 |
| VK1-05_t2_3_9 | CCTGATGATTTTGCAACTTATTACTGCCAGCAGBHCAATMBCYWC YCTCCTACTTTTGGCGGAGGGACCAAG | CAGCAGBHCAATMBCYWCYCTCCT ACT | 2031 | 2632 |
| VK1-05_t3_0_9 | CCTGATGATTTTGCAACTTATTACTGCCAGCAGBHCVRMAGTYWC YCTTWCACTTTTGGCGGAGGGACCAAG | CAGCAGBHCVRMAGTYWCYCTTWC ACT | 2032 | 2633 |
| VK1-05_t3_1_9 | CCTGATGATTTTGCAACTTATTACTGCCAGCAGBHCVRMAGTYWC YCTMTCACTTTTGGCGGAGGGACCAAG | CAGCAGBHCVRMAGTYWCYCTMTC ACT | 2033 | 2634 |
| VK1-05_t3_2_9 | CCTGATGATTTTGCAACTTATTACTGCCAGCAGBHCVRMAGTYWC YCTWGGACTTTTGGCGGAGGGACCAAG | CAGCAGBHCVRMAGTYWCYCTWGG ACT | 2034 | 2635 |
| VK1-05_t3_3_9 | CCTGATGATTTTGCAACTTATTACTGCCAGCAGBHCVRMAGTYWC YCTCCTACTTTTGGCGGAGGGACCAAG | CAGCAGBHCVRMAGTYWCYCTCCT ACT | 2035 | 2636 |
| VK1-05_t4_0_9 | CCTGATGATTTTGCAACTTATTACTGCCAGCAGTACVRMMBCYWC YCTTWCACTTTTGGCGGAGGGACCAAG | CAGCAGTACVRMMBCYWCYCTTWC ACT | 2036 | 2637 |
| VK1-05_t4_1_9 | CCTGATGATTTTGCAACTTATTACTGCCAGCAGTACVRMMBCYWC YCTMTCACTTTTGGCGGAGGGACCAAG | CAGCAGTACVRMMBCYWCYCTMTC ACT | 2037 | 2638 |
| VK1-05_t4_2_9 | CCTGATGATTTTGCAACTTATTACTGCCAGCAGTACVRMMBCYWC YCTWGGACTTTTGGCGGAGGGACCAAG | CAGCAGTACVRMMBCYWCYCTWGG ACT | 2038 | 2639 |
| VK1-05_t4_3_9 | CCTGATGATTTTGCAACTTATTACTGCCAGCAGTACVRMMBCYWC YCTCCTACTTTTGGCGGAGGGACCAAG | CAGCAGTACVRMMBCYWCYCTCCT ACT | 2039 | 2640 |
| VK1-12_t1_0_9 | CCTGAAGATTTTGCAACTTATTACTGTCAGCAGRNANHCNHCTTC CCTTWCACTTTTGGCGGAGGGACCAAG | CAGCAGRNANHCNHCTTCCCTTWC ACT | 2040 | 2641 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_t1_1_9 | CCTGAAGATTTTGCAACTTATTACTGTCAGCAGRNANHCNHCTTCCCTMTCACTTTTGGCGGAGGGACCAAG | CAGCAGRNANHCNHCTTCCCTMTCACT | 2041 | 2642 |
| VK1-12_t1_2_9 | CCTGAAGATTTTGCAACTTATTACTGTCAGCAGRNANHCNHCTTCCCTWGGACTTTTGGCGGAGGGACCAAG | CAGCAGRNANHCNHCTTCCCTWGGACT | 2042 | 2643 |
| VK1-12_t1_3_9 | CCTGAAGATTTTGCAACTTATTACTGTCAGCAGRNANHCNHCTTCCCTCCTACTTTTGGCGGAGGGACCAAG | CAGCAGRNANHCNHCTTCCCTCCTACT | 2043 | 2644 |
| VK1-12_t2_0_9 | CCTGAAGATTTTGCAACTTATTACTGTCAGCAGRNANHCAGTYWCCCTTWCACTTTTGGCGGAGGGACCAAG | CAGCAGRNANHCAGTYWCCCTTWCACT | 2044 | 2645 |
| VK1-12_t2_1_9 | CCTGAAGATTTTGCAACTTATTACTGTCAGCAGRNANHCAGTYWCCCTMTCACTTTTGGCGGAGGGACCAAG | CAGCAGRNANHCAGTYWCCCTMTCACT | 2045 | 2646 |
| VK1-12_t2_2_9 | CCTGAAGATTTTGCAACTTATTACTGTCAGCAGRNANHCAGTYWCCCTWGGACTTTTGGCGGAGGGACCAAG | CAGCAGRNANHCAGTYWCCCTWGGACT | 2046 | 2647 |
| VK1-12_t2_3_9 | CCTGAAGATTTTGCAACTTATTACTGTCAGCAGRNANHCAGTYWCCCTCCTACTTTTGGCGGAGGGACCAAG | CAGCAGRNANHCAGTYWCCCTCCTACT | 2047 | 2648 |
| VK1-12_t3_0_9 | CCTGAAGATTTTGCAACTTATTACTGTCAGCAGRNAAATNHCYWCCCTTWCACTTTTGGCGGAGGGACCAAG | CAGCAGRNAAATNHCYWCCCTTWCACT | 2048 | 2649 |
| VK1-12_t3_1_9 | CCTGAAGATTTTGCAACTTATTACTGTCAGCAGRNAAATNHCYWCCCTMTCACTTTTGGCGGAGGGACCAAG | CAGCAGRNAAATNHCYWCCCTMTCACT | 2049 | 2650 |
| VK1-12_t3_2_9 | CCTGAAGATTTTGCAACTTATTACTGTCAGCAGRNAAATNHCYWCCCTWGGACTTTTGGCGGAGGGACCAAG | CAGCAGRNAAATNHCYWCCCTWGGACT | 2050 | 2651 |
| VK1-12_t3_3_9 | CCTGAAGATTTTGCAACTTATTACTGTCAGCAGRNAAATNHCYWCCCTCCTACTTTTGGCGGAGGGACCAAG | CAGCAGRNAAATNHCYWCCCTCCTACT | 2051 | 2652 |
| VK1-12_t4_0_9 | CCTGAAGATTTTGCAACTTATTACTGTCAGCAGGCANHCNHCYWCCCTTWCACTTTTGGCGGAGGGACCAAG | CAGCAGGCANHCNHCYWCCCTTWCACT | 2052 | 2653 |
| VK1-12_t4_1_9 | CCTGAAGATTTTGCAACTTATTACTGTCAGCAGGCANHCNHCYWCCCTMTCACTTTTGGCGGAGGGACCAAG | CAGCAGGCANHCNHCYWCCCTMTCACT | 2053 | 2654 |
| VK1-12_t4_2_9 | CCTGAAGATTTTGCAACTTATTACTGTCAGCAGGCANHCNHCYWCCCTWGGACTTTTGGCGGAGGGACCAAG | CAGCAGGCANHCNHCYWCCCTWGGACT | 2054 | 2655 |
| VK1-12_t4_3_9 | CCTGAAGATTTTGCAACTTATTACTGTCAGCAGGCANHCNHCYWCCCTCCTACTTTTGGCGGAGGGACCAAG | CAGCAGGCANHCNHCYWCCCTCCTACT | 2055 | 2656 |
| VK1-33_t1_0_9 | CCTGAAGATATTGCAACATATTACTGTCAGCAGBHCNHCNHCCTCCCTTWCACTTTTGGCGGAGGGACCAAG | CAGCAGBHCNHCNHCCTCCCTTWCACT | 2056 | 2657 |
| VK1-33_t1_1_9 | CCTGAAGATATTGCAACATATTACTGTCAGCAGBHCNHCNHCCTCCCTMTCACTTTTGGCGGAGGGACCAAG | CAGCAGBHCNHCNHCCTCCCTMTCACT | 2057 | 2658 |
| VK1-33_t1_2_9 | CCTGAAGATATTGCAACATATTACTGTCAGCAGBHCNHCNHCCTCCCTWGGACTTTTGGCGGAGGGACCAAG | CAGCAGBHCNHCNHCCTCCCTWGGACT | 2058 | 2659 |
| VK1-33_t1_3_9 | CCTGAAGATATTGCAACATATTACTGTCAGCAGBHCNHCNHCCTCCCTCCTACTTTTGGCGGAGGGACCAAG | CAGCAGBHCNHCNHCCTCCCTCCTACT | 2059 | 2660 |
| VK1-33_t2_0_9 | CCTGAAGATATTGCAACATATTACTGTCAGCAGBHCNHCAATYWCCCTTWCACTTTTGGCGGAGGGACCAAG | CAGCAGBHCNHCAATYWCCCTTWCACT | 2060 | 2661 |
| VK1-33_t2_1_9 | CCTGAAGATATTGCAACATATTACTGTCAGCAGBHCNHCAATYWCCCTMTCACTTTTGGCGGAGGGACCAAG | CAGCAGBHCNHCAATYWCCCTMTCACT | 2061 | 2662 |
| VK1-33_t2_2_9 | CCTGAAGATATTGCAACATATTACTGTCAGCAGBHCNHCAATYWCCCTWGGACTTTTGGCGGAGGGACCAAG | CAGCAGBHCNHCAATYWCCCTWGGACT | 2062 | 2663 |
| VK1-33_t2_3_9 | CCTGAAGATATTGCAACATATTACTGTCAGCAGBHCNHCAATYWCCCTCCTACTTTTGGCGGAGGGACCAAG | CAGCAGBHCNHCAATYWCCCTCCTACT | 2063 | 2664 |
| VK1-33_t3_0_9 | CCTGAAGATATTGCAACATATTACTGTCAGCAGBHCGATNHCYWCCCTTWCACTTTTGGCGGAGGGACCAAG | CAGCAGBHCGATNHCYWCCCTTWCACT | 2064 | 2665 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_t3_1_9 | CCTGAAGATATTGCAACATATTACTGTCAGCAGBHCGATNHCYWCCCTMTCACTTTTGGCGGAGGGACCAAG | CAGCAGBHCGATNHCYWCCCTMTCACT | 2065 | 2666 |
| VK1-33_t3_2_9 | CCTGAAGATATTGCAACATATTACTGTCAGCAGBHCGATNHCYWCCCTWGGACTTTTGGCGGAGGGACCAAG | CAGCAGBHCGATNHCYWCCCTWGGACT | 2066 | 2667 |
| VK1-33_t3_3_9 | CCTGAAGATATTGCAACATATTACTGTCAGCAGBHCGATNHCYWCCCTCCTACTTTTGGCGGAGGGACCAAG | CAGCAGBHCGATNHCYWCCCTCCTACT | 2067 | 2668 |
| VK1-33_t4_0_9 | CCTGAAGATATTGCAACATATTACTGTCAGCAGTACNHCNHCYWCCCTTWCACTTTTGGCGGAGGGACCAAG | CAGCAGTACNHCNHCYWCCCTTWCACT | 2068 | 2669 |
| VK1-33_t4_1_9 | CCTGAAGATATTGCAACATATTACTGTCAGCAGTACNHCNHCYWCCCTMTCACTTTTGGCGGAGGGACCAAG | CAGCAGTACNHCNHCYWCCCTMTCACT | 2069 | 2670 |
| VK1-33_t4_2_9 | CCTGAAGATATTGCAACATATTACTGTCAGCAGTACNHCNHCYWCCCTWGGACTTTTGGCGGAGGGACCAAG | CAGCAGTACNHCNHCYWCCCTWGGACT | 2070 | 2671 |
| VK1-33_t4_3_9 | CCTGAAGATATTGCAACATATTACTGTCAGCAGTACNHCNHCYWCCCTCCTACTTTTGGCGGAGGGACCAAG | CAGCAGTACNHCNHCYWCCCTCCTACT | 2071 | 2672 |
| VK1-39_t1_0_9 | CCTGAAGATTTTGCAACTTACTACTGTCAGCAAVNABHCNHCACTCCTTWCACTTTTGGCGGAGGGACCAAG | CAGCAAVNABHCNHCACTCCTTWCACT | 2072 | 320 |
| VK1-39_t1_1_9 | CCTGAAGATTTTGCAACTTACTACTGTCAGCAAVNABHCNHCACTCCTMTCACTTTTGGCGGAGGGACCAAG | CAGCAAVNABHCNHCACTCCTMTCACT | 2073 | 2673 |
| VK1-39_t1_2_9 | CCTGAAGATTTTGCAACTTACTACTGTCAGCAAVNABHCNHCACTCCTWGGACTTTTGGCGGAGGGACCAAG | CAGCAAVNABHCNHCACTCCTWGGACT | 2074 | 2674 |
| VK1-39_t1_3_9 | CCTGAAGATTTTGCAACTTACTACTGTCAGCAAVNABHCNHCACTCCTCCTACTTTTGGCGGAGGGACCAAG | CAGCAAVNABHCNHCACTCCTCCTACT | 2075 | 2675 |
| VK1-39_t2_0_9 | CCTGAAGATTTTGCAACTTACTACTGTCAGCAAVNABHCAGTBHCCCTTWCACTTTTGGCGGAGGGACCAAG | CAGCAAVNABHCAGTBHCCCTTWCACT | 2076 | 321 |
| VK1-39_t2_1_9 | CCTGAAGATTTTGCAACTTACTACTGTCAGCAAVNABHCAGTBHCCCTMTCACTTTTGGCGGAGGGACCAAG | CAGCAAVNABHCAGTBHCCCTMTCACT | 2077 | 2676 |
| VK1-39_t2_2_9 | CCTGAAGATTTTGCAACTTACTACTGTCAGCAAVNABHCAGTBHCCCTWGGACTTTTGGCGGAGGGACCAAG | CAGCAAVNABHCAGTBHCCCTWGGACT | 2078 | 2677 |
| VK1-39_t2_3_9 | CCTGAAGATTTTGCAACTTACTACTGTCAGCAAVNABHCAGTBHCCCTCCTACTTTTGGCGGAGGGACCAAG | CAGCAAVNABHCAGTBHCCCTCCTACT | 2079 | 2678 |
| VK1-39_t3_0_9 | CCTGAAGATTTTGCAACTTACTACTGTCAGCAAVNATACNHCBHCCCTTWCACTTTTGGCGGAGGGACCAAG | CAGCAAVNATACNHCBHCCCTTWCACT | 2080 | 322 |
| VK1-39_t3_1_9 | CCTGAAGATTTTGCAACTTACTACTGTCAGCAAVNATACNHCBHCCCTMTCACTTTTGGCGGAGGGACCAAG | CAGCAAVNATACNHCBHCCCTMTCACT | 2081 | 2679 |
| VK1-39_t3_2_9 | CCTGAAGATTTTGCAACTTACTACTGTCAGCAAVNATACNHCBHCCCTWGGACTTTTGGCGGAGGGACCAAG | CAGCAAVNATACNHCBHCCCTWGGACT | 2082 | 2680 |
| VK1-39_t3_3_9 | CCTGAAGATTTTGCAACTTACTACTGTCAGCAAVNATACNHCBHCCCTCCTACTTTTGGCGGAGGGACCAAG | CAGCAAVNATACNHCBHCCCTCCTACT | 2083 | 2681 |
| VK1-39_t4_0_9 | CCTGAAGATTTTGCAACTTACTACTGTCAGCAAAGCBHCNHCBHCCCTTWCACTTTTGGCGGAGGGACCAAG | CAGCAAAGCBHCNHCBHCCCTTWCACT | 2084 | 323 |
| VK1-39_t4_1_9 | CCTGAAGATTTTGCAACTTACTACTGTCAGCAAAGCBHCNHCBHCCCTMTCACTTTTGGCGGAGGGACCAAG | CAGCAAAGCBHCNHCBHCCCTMTCACT | 2085 | 2682 |
| VK1-39_t4_2_9 | CCTGAAGATTTTGCAACTTACTACTGTCAGCAAAGCBHCNHCBHCCCTWGGACTTTTGGCGGAGGGACCAAG | CAGCAAAGCBHCNHCBHCCCTWGGACT | 2086 | 2683 |
| VK1-39_t4_3_9 | CCTGAAGATTTTGCAACTTACTACTGTCAGCAAAGCBHCNHCBHCCCTCCTACTTTTGGCGGAGGGACCAAG | CAGCAAAGCBHCNHCBHCCCTCCTACT | 2087 | 2684 |
| VK2-28_t1_0_9 | GCTGAGGATGTTGGGGTTTATTACTGCATGCAGVNAMNASRMACTCCTTWCACTTTTGGCGGAGGGACCAAG | ATGCAGVNAMNASRMACTCCTTWCACT | 2088 | 2685 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK2-28_t1_1_9 | GCTGAGGATGTTGGGGTTTATTACTGCATGCAGVNAMNASRMACTCCTMTCACTTTTGGCGGAGGGACCAAG | ATGCAGVNAMNASRMACTCCTMTCACT | 2089 | 2686 |
| VK2-28_t1_2_9 | GCTGAGGATGTTGGGGTTTATTACTGCATGCAGVNAMNASRMACTCCTWGGACTTTTGGCGGAGGGACCAAG | ATGCAGVNAMNASRMACTCCTWGGACT | 2090 | 2687 |
| VK2-28_t1_3_9 | GCTGAGGATGTTGGGGTTTATTACTGCATGCAGVNAMNASRMACTCCTCCTACTTTTGGCGGAGGGACCAAG | ATGCAGVNAMNASRMACTCCTCCTACT | 2091 | 2688 |
| VK2-28_t2_0_9 | GCTGAGGATGTTGGGGTTTATTACTGCATGCAGVNAMNACAGVBCCCTTWCACTTTTGGCGGAGGGACCAAG | ATGCAGVNAMNACAGVBCCCTTWCACT | 2092 | 2689 |
| VK2-28_t2_1_9 | GCTGAGGATGTTGGGGTTTATTACTGCATGCAGVNAMNACAGVBCCCTMTCACTTTTGGCGGAGGGACCAAG | ATGCAGVNAMNACAGVBCCCTMTCACT | 2093 | 2690 |
| VK2-28_t2_2_9 | GCTGAGGATGTTGGGGTTTATTACTGCATGCAGVNAMNACAGVBCCCTWGGACTTTTGGCGGAGGGACCAAG | ATGCAGVNAMNACAGVBCCCTWGGACT | 2094 | 2691 |
| VK2-28_t2_3_9 | GCTGAGGATGTTGGGGTTTATTACTGCATGCAGVNAMNACAGVBCCCTCCTACTTTTGGCGGAGGGACCAAG | ATGCAGVNAMNACAGVBCCCTCCTACT | 2095 | 2692 |
| VK2-28_t3_0_9 | GCTGAGGATGTTGGGGTTTATTACTGCATGCAGVNACTCSRMVBCCCTTWCACTTTTGGCGGAGGGACCAAG | ATGCAGVNACTCSRMVBCCCTTWCACT | 2096 | 2693 |
| VK2-28_t3_1_9 | GCTGAGGATGTTGGGGTTTATTACTGCATGCAGVNACTCSRMVBCCCTMTCACTTTTGGCGGAGGGACCAAG | ATGCAGVNACTCSRMVBCCCTMTCACT | 2097 | 2694 |
| VK2-28_t3_2_9 | GCTGAGGATGTTGGGGTTTATTACTGCATGCAGVNACTCSRMVBCCCTWGGACTTTTGGCGGAGGGACCAAG | ATGCAGVNACTCSRMVBCCCTWGGACT | 2098 | 2695 |
| VK2-28_t3_3_9 | GCTGAGGATGTTGGGGTTTATTACTGCATGCAGVNACTCSRMVBCCCTCCTACTTTTGGCGGAGGGACCAAG | ATGCAGVNACTCSRMVBCCCTCCTACT | 2099 | 2696 |
| VK2-28_t4_0_9 | GCTGAGGATGTTGGGGTTTATTACTGCATGCAGGCAMNASRMVBCCCTTWCACTTTTGGCGGAGGGACCAAG | ATGCAGGCAMNASRMVBCCCTTWCACT | 2100 | 2697 |
| VK2-28_t4_1_9 | GCTGAGGATGTTGGGGTTTATTACTGCATGCAGGCAMNASRMVBCCCTMTCACTTTTGGCGGAGGGACCAAG | ATGCAGGCAMNASRMVBCCCTMTCACT | 2101 | 2698 |
| VK2-28_t4_2_9 | GCTGAGGATGTTGGGGTTTATTACTGCATGCAGGCAMNASRMVBCCCTWGGACTTTTGGCGGAGGGACCAAG | ATGCAGGCAMNASRMVBCCCTWGGACT | 2102 | 2699 |
| VK2-28_t4_3_9 | GCTGAGGATGTTGGGGTTTATTACTGCATGCAGGCAMNASRMVBCCCTCCTACTTTTGGCGGAGGGACCAAG | ATGCAGGCAMNASRMVBCCCTCCTACT | 2103 | 2700 |
| VK3-11_t1_0_9 | CCTGAAGATTTTGCAGTTTATTACTGTCAGCAGBHCNHCNHCTGGCCTTWCACTTTTGGCGGAGGGACCAAG | CAGCAGBHCNHCNHCTGGCCTTWCACT | 2104 | 2701 |
| VK3-11_t1_1_9 | CCTGAAGATTTTGCAGTTTATTACTGTCAGCAGBHCNHCNHCTGGCCTMTCACTTTTGGCGGAGGGACCAAG | CAGCAGBHCNHCNHCTGGCCTMTCACT | 2105 | 2702 |
| VK3-11_t1_2_9 | CCTGAAGATTTTGCAGTTTATTACTGTCAGCAGBHCNHCNHCTGGCCTWGGACTTTTGGCGGAGGGACCAAG | CAGCAGBHCNHCNHCTGGCCTWGGACT | 2106 | 2703 |
| VK3-11_t1_3_9 | CCTGAAGATTTTGCAGTTTATTACTGTCAGCAGBHCNHCNHCTGGCCTCCTACTTTTGGCGGAGGGACCAAG | CAGCAGBHCNHCNHCTGGCCTCCTACT | 2107 | 2704 |
| VK3-11_t2_0_9 | CCTGAAGATTTTGCAGTTTATTACTGTCAGCAGBHCNHCAATYWCCCTTWCACTTTTGGCGGAGGGACCAAG | CAGCAGBHCNHCAATYWCCCTTWCACT | 2108 | 2661 |
| VK3-11_t2_1_9 | CCTGAAGATTTTGCAGTTTATTACTGTCAGCAGBHCNHCAATYWCCCTMTCACTTTTGGCGGAGGGACCAAG | CAGCAGBHCNHCAATYWCCCTMTCACT | 2109 | 2662 |
| VK3-11_t2_2_9 | CCTGAAGATTTTGCAGTTTATTACTGTCAGCAGBHCNHCAATYWCCCTWGGACTTTTGGCGGAGGGACCAAG | CAGCAGBHCNHCAATYWCCCTWGGACT | 2110 | 2663 |
| VK3-11_t2_3_9 | CCTGAAGATTTTGCAGTTTATTACTGTCAGCAGBHCNHCAATYWCCCTCCTACTTTTGGCGGAGGGACCAAG | CAGCAGBHCNHCAATYWCCCTCCTACT | 2111 | 2664 |
| VK3-11_t3_0_9 | CCTGAAGATTTTGCAGTTTATTACTGTCAGCAGBHCAGTNHCYWCCCTTWCACTTTTGGCGGAGGGACCAAG | CAGCAGBHCAGTNHCYWCCCTTWCACT | 2112 | 2705 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_t3_1_9 | CCTGAAGATTTTGCAGTTTATTACTGTCAGCAGBHCAGTNHCYWCCCTMTCACTTTTGGCGGAGGGACCAAG | CAGCAGBHCAGTNHCYWCCCTMTCACT | 2113 | 2706 |
| VK3-11_t3_2_9 | CCTGAAGATTTTGCAGTTTATTACTGTCAGCAGBHCAGTNHCYWCCCTWGGACTTTTGGCGGAGGGACCAAG | CAGCAGBHCAGTNHCYWCCCTWGGACT | 2114 | 2707 |
| VK3-11_t3_3_9 | CCTGAAGATTTTGCAGTTTATTACTGTCAGCAGBHCAGTNHCYWCCCTCCTACTTTTGGCGGAGGGACCAAG | CAGCAGBHCAGTNHCYWCCCTCCTACT | 2115 | 2708 |
| VK3-11_t4_0_9 | CCTGAAGATTTTGCAGTTTATTACTGTCAGCAGAGANHCNHCYWCCCTTWCACTTTTGGCGGAGGGACCAAG | CAGCAGAGANHCNHCYWCCCTTWCACT | 2116 | 2709 |
| VK3-11_t4_1_9 | CCTGAAGATTTTGCAGTTTATTACTGTCAGCAGAGANHCNHCYWCCCTMTCACTTTTGGCGGAGGGACCAAG | CAGCAGAGANHCNHCYWCCCTMTCACT | 2117 | 2710 |
| VK3-11_t4_2_9 | CCTGAAGATTTTGCAGTTTATTACTGTCAGCAGAGANHCNHCYWCCCTWGGACTTTTGGCGGAGGGACCAAG | CAGCAGAGANHCNHCYWCCCTWGGACT | 2118 | 2711 |
| VK3-11_t4_3_9 | CCTGAAGATTTTGCAGTTTATTACTGTCAGCAGAGANHCNHCYWCCCTCCTACTTTTGGCGGAGGGACCAAG | CAGCAGAGANHCNHCYWCCCTCCTACT | 2119 | 2712 |
| VK3-15_t1_0_9 | CAGTCTGAAGATTTTGCAGTTTATTACTGTCAGCAGBHCNHCNHCTGGCCTTWCACTTTTGGCGGAGGGACCAAG | CAGCAGBHCNHCNHCTGGCCTTWCACT | 2120 | 2701 |
| VK3-15_t1_1_9 | CAGTCTGAAGATTTTGCAGTTTATTACTGTCAGCAGBHCNHCNHCTGGCCTMTCACTTTTGGCGGAGGGACCAAG | CAGCAGBHCNHCNHCTGGCCTMTCACT | 2121 | 2702 |
| VK3-15_t1_2_9 | CAGTCTGAAGATTTTGCAGTTTATTACTGTCAGCAGBHCNHCNHCTGGCCTWGGACTTTTGGCGGAGGGACCAAG | CAGCAGBHCNHCNHCTGGCCTWGGACT | 2122 | 2703 |
| VK3-15_t1_3_9 | CAGTCTGAAGATTTTGCAGTTTATTACTGTCAGCAGBHCNHCNHCTGGCCTCCTACTTTTGGCGGAGGGACCAAG | CAGCAGBHCNHCNHCTGGCCTCCTACT | 2123 | 2704 |
| VK3-15_t2_0_9 | CAGTCTGAAGATTTTGCAGTTTATTACTGTCAGCAGBHCNHCAATYWCCCTTWCACTTTTGGCGGAGGGACCAAG | CAGCAGBHCNHCAATYWCCCTTWCACT | 2124 | 2661 |
| VK3-15_t2_1_9 | CAGTCTGAAGATTTTGCAGTTTATTACTGTCAGCAGBHCNHCAATYWCCCTMTCACTTTTGGCGGAGGGACCAAG | CAGCAGBHCNHCAATYWCCCTMTCACT | 2125 | 2662 |
| VK3-15_t2_2_9 | CAGTCTGAAGATTTTGCAGTTTATTACTGTCAGCAGBHCNHCAATYWCCCTWGGACTTTTGGCGGAGGGACCAAG | CAGCAGBHCNHCAATYWCCCTWGGACT | 2126 | 2663 |
| VK3-15_t2_3_9 | CAGTCTGAAGATTTTGCAGTTTATTACTGTCAGCAGBHCNHCAATYWCCCTCCTACTTTTGGCGGAGGGACCAAG | CAGCAGBHCNHCAATYWCCCTCCTACT | 2127 | 2664 |
| VK3-15_t3_0_9 | CAGTCTGAAGATTTTGCAGTTTATTACTGTCAGCAGBHCAATNHCYWCCCTTWCACTTTTGGCGGAGGGACCAAG | CAGCAGBHCAATNHCYWCCCTTWCACT | 2128 | 2713 |
| VK3-15_t3_1_9 | CAGTCTGAAGATTTTGCAGTTTATTACTGTCAGCAGBHCAATNHCYWCCCTMTCACTTTTGGCGGAGGGACCAAG | CAGCAGBHCAATNHCYWCCCTMTCACT | 2129 | 2714 |
| VK3-15_t3_2_9 | CAGTCTGAAGATTTTGCAGTTTATTACTGTCAGCAGBHCAATNHCYWCCCTWGGACTTTTGGCGGAGGGACCAAG | CAGCAGBHCAATNHCYWCCCTWGGACT | 2130 | 2715 |
| VK3-15_t3_3_9 | CAGTCTGAAGATTTTGCAGTTTATTACTGTCAGCAGBHCAATNHCYWCCCTCCTACTTTTGGCGGAGGGACCAAG | CAGCAGBHCAATNHCYWCCCTCCTACT | 2131 | 2716 |
| VK3-15_t4_0_9 | CAGTCTGAAGATTTTGCAGTTTATTACTGTCAGCAGTACNHCNHCYWCCCTTWCACTTTTGGCGGAGGGACCAAG | CAGCAGTACNHCNHCYWCCCTTWCACT | 2132 | 2669 |
| VK3-15_t4_1_9 | CAGTCTGAAGATTTTGCAGTTTATTACTGTCAGCAGTACNHCNHCYWCCCTMTCACTTTTGGCGGAGGGACCAAG | CAGCAGTACNHCNHCYWCCCTMTCACT | 2133 | 2670 |
| VK3-15_t4_2_9 | CAGTCTGAAGATTTTGCAGTTTATTACTGTCAGCAGTACNHCNHCYWCCCTWGGACTTTTGGCGGAGGGACCAAG | CAGCAGTACNHCNHCYWCCCTWGGACT | 2134 | 2671 |
| VK3-15_t4_3_9 | CAGTCTGAAGATTTTGCAGTTTATTACTGTCAGCAGTACNHCNHCYWCCCTCCTACTTTTGGCGGAGGGACCAAG | CAGCAGTACNHCNHCYWCCCTCCTACT | 2135 | 2672 |
| VK3-20_t1_0_9 | CCTGAAGATTTTGCAGTGTATTACTGTCAGCAGBHCBHCVNCAGTCCTTWCACTTTTGGCGGAGGGACCAAG | CAGCAGBHCBHCVNCAGTCCTTWCACT | 2136 | 2717 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_t1_1_9 | CCTGAAGATTTTGCAGTGTATTACTGTCAGCAGBHCBHCVNCAGTCCTMTCACTTTTGGCGGAGGGACCAAG | CAGCAGBHCBHCVNCAGTCCTMTCACT | 2137 | 2718 |
| VK3-20_t1_2_9 | CCTGAAGATTTTGCAGTGTATTACTGTCAGCAGBHCBHCVNCAGTCCTWGGACTTTTGGCGGAGGGACCAAG | CAGCAGBHCBHCVNCAGTCCTWGGACT | 2138 | 2719 |
| VK3-20_t1_3_9 | CCTGAAGATTTTGCAGTGTATTACTGTCAGCAGBHCBHCVNCAGTCCTCCTACTTTTGGCGGAGGGACCAAG | CAGCAGBHCBHCVNCAGTCCTCCTACT | 2139 | 2720 |
| VK3-20_t2_0_9 | CCTGAAGATTTTGCAGTGTATTACTGTCAGCAGBHCBHCAGTBHCCCTTWCACTTTTGGCGGAGGGACCAAG | CAGCAGBHCBHCAGTBHCCCTTWCACT | 2140 | 2721 |
| VK3-20_t2_1_9 | CCTGAAGATTTTGCAGTGTATTACTGTCAGCAGBHCBHCAGTBHCCCTMTCACTTTTGGCGGAGGGACCAAG | CAGCAGBHCBHCAGTBHCCCTMTCACT | 2141 | 2722 |
| VK3-20_t2_2_9 | CCTGAAGATTTTGCAGTGTATTACTGTCAGCAGBHCBHCAGTBHCCCTWGGACTTTTGGCGGAGGGACCAAG | CAGCAGBHCBHCAGTBHCCCTWGGACT | 2142 | 2723 |
| VK3-20_t2_3_9 | CCTGAAGATTTTGCAGTGTATTACTGTCAGCAGBHCBHCAGTBHCCCTCCTACTTTTGGCGGAGGGACCAAG | CAGCAGBHCBHCAGTBHCCCTCCTACT | 2143 | 2724 |
| VK3-20_t3_0_9 | CCTGAAGATTTTGCAGTGTATTACTGTCAGCAGBHCGGAVNCBHCCCTTWCACTTTTGGCGGAGGGACCAAG | CAGCAGBHCGGAVNCBHCCCTTWCACT | 2144 | 2725 |
| VK3-20_t3_1_9 | CCTGAAGATTTTGCAGTGTATTACTGTCAGCAGBHCGGAVNCBHCCCTMTCACTTTTGGCGGAGGGACCAAG | CAGCAGBHCGGAVNCBHCCCTMTCACT | 2145 | 2726 |
| VK3-20_t3_2_9 | CCTGAAGATTTTGCAGTGTATTACTGTCAGCAGBHCGGAVNCBHCCCTWGGACTTTTGGCGGAGGGACCAAG | CAGCAGBHCGGAVNCBHCCCTWGGACT | 2146 | 2727 |
| VK3-20_t3_3_9 | CCTGAAGATTTTGCAGTGTATTACTGTCAGCAGBHCGGAVNCBHCCCTCCTACTTTTGGCGGAGGGACCAAG | CAGCAGBHCGGAVNCBHCCCTCCTACT | 2147 | 2728 |
| VK3-20_t4_0_9 | CCTGAAGATTTTGCAGTGTATTACTGTCAGCAGTACBHCVNCBHCCCTTWCACTTTTGGCGGAGGGACCAAG | CAGCAGTACBHCVNCBHCCCTTWCACT | 2148 | 2729 |
| VK3-20_t4_1_9 | CCTGAAGATTTTGCAGTGTATTACTGTCAGCAGTACBHCVNCBHCCCTMTCACTTTTGGCGGAGGGACCAAG | CAGCAGTACBHCVNCBHCCCTMTCACT | 2149 | 2730 |
| VK3-20_t4_2_9 | CCTGAAGATTTTGCAGTGTATTACTGTCAGCAGTACBHCVNCBHCCCTWGGACTTTTGGCGGAGGGACCAAG | CAGCAGTACBHCVNCBHCCCTWGGACT | 2150 | 2731 |
| VK3-20_t4_3_9 | CCTGAAGATTTTGCAGTGTATTACTGTCAGCAGTACBHCVNCBHCCCTCCTACTTTTGGCGGAGGGACCAAG | CAGCAGTACBHCVNCBHCCCTCCTACT | 2151 | 2732 |
| VK4-01_t1_0_9 | GCTGAAGATGTGGCAGTTTATTACTGTCAGCAGBHCBHCNHCACTCCTTWCACTTTTGGCGGAGGGACCAAG | CAGCAGBHCBHCNHCACTCCTTWCACT | 2152 | 2733 |
| VK4-01_t1_1_9 | GCTGAAGATGTGGCAGTTTATTACTGTCAGCAGBHCBHCNHCACTCCTMTCACTTTTGGCGGAGGGACCAAG | CAGCAGBHCBHCNHCACTCCTMTCACT | 2153 | 2734 |
| VK4-01_t1_2_9 | GCTGAAGATGTGGCAGTTTATTACTGTCAGCAGBHCBHCNHCACTCCTWGGACTTTTGGCGGAGGGACCAAG | CAGCAGBHCBHCNHCACTCCTWGGACT | 2154 | 2735 |
| VK4-01_t1_3_9 | GCTGAAGATGTGGCAGTTTATTACTGTCAGCAGBHCBHCNHCACTCCTCCTACTTTTGGCGGAGGGACCAAG | CAGCAGBHCBHCNHCACTCCTCCTACT | 2155 | 2736 |
| VK4-01_t2_0_9 | GCTGAAGATGTGGCAGTTTATTACTGTCAGCAGBHCBHCAGTBHCCCTTWCACTTTTGGCGGAGGGACCAAG | CAGCAGBHCBHCAGTBHCCCTTWCACT | 2156 | 2721 |
| VK4-01_t2_1_9 | GCTGAAGATGTGGCAGTTTATTACTGTCAGCAGBHCBHCAGTBHCCCTMTCACTTTTGGCGGAGGGACCAAG | CAGCAGBHCBHCAGTBHCCCTMTCACT | 2157 | 2722 |
| VK4-01_t2_2_9 | GCTGAAGATGTGGCAGTTTATTACTGTCAGCAGBHCBHCAGTBHCCCTWGGACTTTTGGCGGAGGGACCAAG | CAGCAGBHCBHCAGTBHCCCTWGGACT | 2158 | 2723 |
| VK4-01_t2_3_9 | GCTGAAGATGTGGCAGTTTATTACTGTCAGCAGBHCBHCAGTBHCCCTCCTACTTTTGGCGGAGGGACCAAG | CAGCAGBHCBHCAGTBHCCCTCCTACT | 2159 | 2724 |
| VK4-01_t3_0_9 | GCTGAAGATGTGGCAGTTTATTACTGTCAGCAGBHCTACNHCBHCCCTTWCACTTTTGGCGGAGGGACCAAG | CAGCAGBHCTACNHCBHCCCTTWCACT | 2160 | 2737 |

TABLE 6-continued

Oligonucleotide sequences for exemplary VK jumping dimer and trimer sequences with CDRL3 length 9.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK4-01_t3_1_9 | GCTGAAGATGTGGCAGTTTATTACTGTCAGCAGBHCTACNHCBHCCCTMTCACTTTTGGCGGAGGGACCAAG | CAGCAGBHCTACNHCBHCCCTMTCACT | 2161 | 2738 |
| VK4-01_t3_2_9 | GCTGAAGATGTGGCAGTTTATTACTGTCAGCAGBHCTACNHCBHCCCTWGGACTTTTGGCGGAGGGACCAAG | CAGCAGBHCTACNHCBHCCCTWGGACT | 2162 | 2739 |
| VK4-01_t3_3_9 | GCTGAAGATGTGGCAGTTTATTACTGTCAGCAGBHCTACNHCBHCCCTCCTACTTTTGGCGGAGGGACCAAG | CAGCAGBHCTACNHCBHCCCTCCTACT | 2163 | 2740 |
| VK4-01_t4_0_9 | GCTGAAGATGTGGCAGTTTATTACTGTCAGCAGTACBHCNHCBHCCCTTWCACTTTTGGCGGAGGGACCAAG | CAGCAGTACBHCNHCBHCCCTTWCACT | 2164 | 2741 |
| VK4-01_t4_1_9 | GCTGAAGATGTGGCAGTTTATTACTGTCAGCAGTACBHCNHCBHCCCTMTCACTTTTGGCGGAGGGACCAAG | CAGCAGTACBHCNHCBHCCCTMTCACT | 2165 | 2742 |
| VK4-01_t4_2_9 | GCTGAAGATGTGGCAGTTTATTACTGTCAGCAGTACBHCNHCBHCCCTWGGACTTTTGGCGGAGGGACCAAG | CAGCAGTACBHCNHCBHCCCTWGGACT | 2166 | 2743 |
| VK4-01_t4_3_9 | GCTGAAGATGTGGCAGTTTATTACTGTCAGCAGTACBHCNHCBHCCCTCCTACTTTTGGCGGAGGGACCAAG | CAGCAGTACBHCNHCBHCCCTCCTACT | 2167 | 2744 |

TABLE 7

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| Jumping Dimer | | | | |
| VK1-05_1_0_10 | CCTGATGATTTTGCAACTTATTACTGCSWMSWMTACAATAGTTACYCTCCTTWCACTTTTGGCGGAGGGACCAAG | SWMSWMTACAATAGTTACYCTCCTTWCACT | 2745 | 3213 |
| VK1-05_10_0_10 | CCTGATGATTTTGCAACTTATTACTGCCAGCAGBHCVRMAGTTACYCTCCTTWCACTTTTGGCGGAGGGACCAAG | CAGCAGBHCVRMAGTTACYCTCCTTWCACT | 2746 | 3214 |
| VK1-05_11_0_10 | CCTGATGATTTTGCAACTTATTACTGCCAGCAGBHCAATMBCTACYCTCCTTWCACTTTTGGCGGAGGGACCAAG | CAGCAGBHCAATMBCTACYCTCCTTWCACT | 2747 | 3215 |
| VK1-05_12_0_10 | CCTGATGATTTTGCAACTTATTACTGCCAGCAGBHCAATAGTYWCYCTCCTTWCACTTTTGGCGGAGGGACCAAG | CAGCAGBHCAATAGTYWCYCTCCTTWCACT | 2748 | 3216 |
| VK1-05_13_0_10 | CCTGATGATTTTGCAACTTATTACTGCCAGCAGTACVRMMBCTACYCTCCTTWCACTTTTGGCGGAGGGACCAAG | CAGCAGTACVRMMBCTACYCTCCTTWCACT | 2749 | 3217 |
| VK1-05_14_0_10 | CCTGATGATTTTGCAACTTATTACTGCCAGCAGTACVRMAGTYWCYCTCCTTWCACTTTTGGCGGAGGGACCAAG | CAGCAGTACVRMAGTYWCYCTCCTTWCACT | 2750 | 3218 |
| VK1-05_15_0_10 | CCTGATGATTTTGCAACTTATTACTGCCAGCAGTACAATMBCYWCYCTCCTTWCACTTTTGGCGGAGGGACCAAG | CAGCAGTACAATMBCYWCYCTCCTTWCACT | 2751 | 3219 |
| VK1-05_2_0_10 | CCTGATGATTTTGCAACTTATTACTGCSWMCAGBHCAATAGTTACYCTCCTTWCACTTTTGGCGGAGGGACCAAG | SWMCAGBHCAATAGTTACYCTCCTTWCACT | 2752 | 3220 |
| VK1-05_3_0_10 | CCTGATGATTTTGCAACTTATTACTGCSWMCAGTACVRMAGTTACYCTCCTTWCACTTTTGGCGGAGGGACCAAG | SWMCAGTACVRMAGTTACYCTCCTTWCACT | 2753 | 3221 |
| VK1-05_4_0_10 | CCTGATGATTTTGCAACTTATTACTGCSWMCAGTACAATMBCTACYCTCCTTWCACTTTTGGCGGAGGGACCAAG | SWMCAGTACAATMBCTACYCTCCTTWCACT | 2754 | 3222 |
| VK1-05_5_0_10 | CCTGATGATTTTGCAACTTATTACTGCSWMCAGTACAATAGTYWCYCTCCTTWCACTTTTGGCGGAGGGACCAAG | SWMCAGTACAATAGTYWCYCTCCTTWCACT | 2755 | 3223 |
| VK1-05_6_0_10 | CCTGATGATTTTGCAACTTATTACTGCCAGSWMBHCAATAGTTACYCTCCTTWCACTTTTGGCGGAGGGACCAAG | CAGSWMBHCAATAGTTACYCTCCTTWCACT | 2756 | 3224 |
| VK1-05_7_0_10 | CCTGATGATTTTGCAACTTATTACTGCCAGSWMTACVRMAGTTACYCTCCTTWCACTTTTGGCGGAGGGACCAAG | CAGSWMTACVRMAGTTACYCTCCTTWCACT | 2757 | 3225 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK1-05_8_0_10 | CCTGATGATTTTGCAACTTATTACTGCCAGSWMTACAATMBCTACYCTCCTTWCACTTTTGGCGGAGGGACCAAG | CAGSWMTACAATMBCTACYCTCCTTWCACT | 2758 | 3226 |
| VK1-05_9_0_10 | CCTGATGATTTTGCAACTTATTACTGCCAGSWMTACAATAGTYWCYCTCCTTWCACTTTTGGCGGAGGGACCAAG | CAGSWMTACAATAGTYWCYCTCCTTWCACT | 2759 | 3227 |
| VK1-05_1_1_10 | CCTGATGATTTTGCAACTTATTACTGCSWMSWMTACAATAGTTACYCTCCTMTCACTTTTGGCGGAGGGACCAAG | SWMSWMTACAATAGTTACYCTCCTMTCACT | 2760 | 3228 |
| VK1-05_10_1_10 | CCTGATGATTTTGCAACTTATTACTGCCAGCAGBHCVRMAGTTACYCTCCTMTCACTTTTGGCGGAGGGACCAAG | CAGCAGBHCVRMAGTTACYCTCCTMTCACT | 2761 | 3229 |
| VK1-05_11_1_10 | CCTGATGATTTTGCAACTTATTACTGCCAGCAGBHCAATMBCTACYCTCCTMTCACTTTTGGCGGAGGGACCAAG | CAGCAGBHCAATMBCTACYCTCCTMTCACT | 2762 | 3230 |
| VK1-05_12_1_10 | CCTGATGATTTTGCAACTTATTACTGCCAGCAGBHCAATAGTYWCYCTCCTMTCACTTTTGGCGGAGGGACCAAG | CAGCAGBHCAATAGTYWCYCTCCTMTCACT | 2763 | 3231 |
| VK1-05_13_1_10 | CCTGATGATTTTGCAACTTATTACTGCCAGCAGTACVRMMBCTACYCTCCTMTCACTTTTGGCGGAGGGACCAAG | CAGCAGTACVRMMBCTACYCTCCTMTCACT | 2764 | 3232 |
| VK1-05_14_1_10 | CCTGATGATTTTGCAACTTATTACTGCCAGCAGTACVRMAGTYWCYCTCCTMTCACTTTTGGCGGAGGGACCAAG | CAGCAGTACVRMAGTYWCYCTCCTMTCACT | 2765 | 3233 |
| VK1-05_15_1_10 | CCTGATGATTTTGCAACTTATTACTGCCAGCAGTACAATMBCYWCYCTCCTMTCACTTTTGGCGGAGGGACCAAG | CAGCAGTACAATMBCYWCYCTCCTMTCACT | 2766 | 3234 |
| VK1-05_2_1_10 | CCTGATGATTTTGCAACTTATTACTGCSWMCAGBHCAATAGTTACYCTCCTMTCACTTTTGGCGGAGGGACCAAG | SWMCAGBHCAATAGTTACYCTCCTMTCACT | 2767 | 3235 |
| VK1-05_3_1_10 | CCTGATGATTTTGCAACTTATTACTGCSWMCAGTACVRMAGTTACYCTCCTMTCACTTTTGGCGGAGGGACCAAG | SWMCAGTACVRMAGTTACYCTCCTMTCACT | 2768 | 3236 |
| VK1-05_4_1_10 | CCTGATGATTTTGCAACTTATTACTGCSWMCAGTACAATMBCTACYCTCCTMTCACTTTTGGCGGAGGGACCAAG | SWMCAGTACAATMBCTACYCTCCTMTCACT | 2769 | 3237 |
| VK1-05_5_1_10 | CCTGATGATTTTGCAACTTATTACTGCSWMCAGTACAATAGTYWCYCTCCTMTCACTTTTGGCGGAGGGACCAAG | SWMCAGTACAATAGTYWCYCTCCTMTCACT | 2770 | 3238 |
| VK1-05_6_1_10 | CCTGATGATTTTGCAACTTATTACTGCCAGSWMBHCAATAGTTACYCTCCTMTCACTTTTGGCGGAGGGACCAAG | CAGSWMBHCAATAGTTACYCTCCTMTCACT | 2771 | 3239 |
| VK1-05_7_1_10 | CCTGATGATTTTGCAACTTATTACTGCCAGSWMTACVRMAGTTACYCTCCTMTCACTTTTGGCGGAGGGACCAAG | CAGSWMTACVRMAGTTACYCTCCTMTCACT | 2772 | 3240 |
| VK1-05_8_1_10 | CCTGATGATTTTGCAACTTATTACTGCCAGSWMTACAATMBCTACYCTCCTMTCACTTTTGGCGGAGGGACCAAG | CAGSWMTACAATMBCTACYCTCCTMTCACT | 2773 | 3241 |
| VK1-05_9_1_10 | CCTGATGATTTTGCAACTTATTACTGCCAGSWMTACAATAGTYWCYCTCCTMTCACTTTTGGCGGAGGGACCAAG | CAGSWMTACAATAGTYWCYCTCCTMTCACT | 2774 | 3242 |
| VK1-05_1_2_10 | CCTGATGATTTTGCAACTTATTACTGCSWMSWMTACAATAGTTACYCTCCTWGGACTTTTGGCGGAGGGACCAAG | SWMSWMTACAATAGTTACYCTCCTWGGACT | 2775 | 3243 |
| VK1-05_10_2_10 | CCTGATGATTTTGCAACTTATTACTGCCAGCAGBHCVRMAGTTACYCTCCTWGGACTTTTGGCGGAGGGACCAAG | CAGCAGBHCVRMAGTTACYCTCCTWGGACT | 2776 | 3244 |
| VK1-05_11_2_10 | CCTGATGATTTTGCAACTTATTACTGCCAGCAGBHCAATMBCTACYCTCCTWGGACTTTTGGCGGAGGGACCAAG | CAGCAGBHCAATMBCTACYCTCCTWGGACT | 2777 | 3245 |
| VK1-05_12_2_10 | CCTGATGATTTTGCAACTTATTACTGCCAGCAGBHCAATAGTYWCYCTCCTWGGACTTTTGGCGGAGGGACCAAG | CAGCAGBHCAATAGTYWCYCTCCTWGGACT | 2778 | 3246 |
| VK1-05_13_2_10 | CCTGATGATTTTGCAACTTATTACTGCCAGCAGTACVRMMBCTACYCTCCTWGGACTTTTGGCGGAGGGACCAAG | CAGCAGTACVRMMBCTACYCTCCTWGGACT | 2779 | 3247 |
| VK1-05_14_2_10 | CCTGATGATTTTGCAACTTATTACTGCCAGCAGTACVRMAGTYWCYCTCCTWGGACTTTTGGCGGAGGGACCAAG | CAGCAGTACVRMAGTYWCYCTCCTWGGACT | 2780 | 3248 |
| VK1-05_15_2_10 | CCTGATGATTTTGCAACTTATTACTGCCAGCAGTACAATMBCYWCYCTCCTWGGACTTTTGGCGGAGGGACCAAG | CAGCAGTACAATMBCYWCYCTCCTWGGACT | 2781 | 3249 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-05_2_2_10 | CCTGATGATTTTGCAACTTATTACTGCSWMCAGBHCAATAGTTACYCTCCTWGGACTTTTGGCGGAGGGACCAAG | SWMCAGBHCAATAGTTACYCTCCTWGGACT | 2782 | 3250 |
| VK1-05_3_2_10 | CCTGATGATTTTGCAACTTATTACTGCSWMCAGTACVRMAGTTACYCTCCTWGGACTTTTGGCGGAGGGACCAAG | SWMCAGTACVRMAGTTACYCTCCTWGGACT | 2783 | 3251 |
| VK1-05_4_2_10 | CCTGATGATTTTGCAACTTATTACTGCSWMCAGTACAATMBCTACYCTCCTWGGACTTTTGGCGGAGGGACCAAG | SWMCAGTACAATMBCTACYCTCCTWGGACT | 2784 | 3252 |
| VK1-05_5_2_10 | CCTGATGATTTTGCAACTTATTACTGCSWMCAGTACAATAGTYWCYCTCCTWGGACTTTTGGCGGAGGGACCAAG | SWMCAGTACAATAGTYWCYCTCCTWGGACT | 2785 | 3253 |
| VK1-05_6_2_10 | CCTGATGATTTTGCAACTTATTACTGCCAGSWMBHCAATAGTTACYCTCCTWGGACTTTTGGCGGAGGGACCAAG | CAGSWMBHCAATAGTTACYCTCCTWGGACT | 2786 | 3254 |
| VK1-05_7_2_10 | CCTGATGATTTTGCAACTTATTACTGCCAGSWMTACVRMAGTTACYCTCCTWGGACTTTTGGCGGAGGGACCAAG | CAGSWMTACVRMAGTTACYCTCCTWGGACT | 2787 | 3255 |
| VK1-05_8_2_10 | CCTGATGATTTTGCAACTTATTACTGCCAGSWMTACAATMBCTACYCTCCTWGGACTTTTGGCGGAGGGACCAAG | CAGSWMTACAATMBCTACYCTCCTWGGACT | 2788 | 3256 |
| VK1-05_9_2_10 | CCTGATGATTTTGCAACTTATTACTGCCAGSWMTACAATAGTYWCYCTCCTWGGACTTTTGGCGGAGGGACCAAG | CAGSWMTACAATAGTYWCYCTCCTWGGACT | 2789 | 3257 |
| VK1-12_1_0_10 | CCTGAAGATTTTGCAACTTATTACTGTSWMSWMGCAAATAGTTTCCCTCCTTWCACTTTTGGCGGAGGGACCAAG | SWMSWMGCAAATAGTTTCCCTCCTTWCACT | 2790 | 3258 |
| VK1-12_10_0_10 | CCTGAAGATTTTGCAACTTATTACTGTCAGCAGRNANHCAGTTTCCCTCCTTWCACTTTTGGCGGAGGGACCAAG | CAGCAGRNANHCAGTTTCCCTCCTTWCACT | 2791 | 3259 |
| VK1-12_11_0_10 | CCTGAAGATTTTGCAACTTATTACTGTCAGCAGRNAAATNHCTTCCCTCCTTWCACTTTTGGCGGAGGGACCAAG | CAGCAGRNAAATNHCTTCCCTCCTTWCACT | 2792 | 3260 |
| VK1-12_12_0_10 | CCTGAAGATTTTGCAACTTATTACTGTCAGCAGRNAAATAGTYWCCCTCCTTWCACTTTTGGCGGAGGGACCAAG | CAGCAGRNAAATAGTYWCCCTCCTTWCACT | 2793 | 3261 |
| VK1-12_13_0_10 | CCTGAAGATTTTGCAACTTATTACTGTCAGCAGGCANHCNHCTTCCCTCCTTWCACTTTTGGCGGAGGGACCAAG | CAGCAGGCANHCNHCTTCCCTCCTTWCACT | 2794 | 3262 |
| VK1-12_14_0_10 | CCTGAAGATTTTGCAACTTATTACTGTCAGCAGGCANHCAGTYWCCCTCCTTWCACTTTTGGCGGAGGGACCAAG | CAGCAGGCANHCAGTYWCCCTCCTTWCACT | 2795 | 3263 |
| VK1-12_15_0_10 | CCTGAAGATTTTGCAACTTATTACTGTCAGCAGGCAAATNHCYWCCCTCCTTWCACTTTTGGCGGAGGGACCAAG | CAGCAGGCAAATNHCYWCCCTCCTTWCACT | 2796 | 3264 |
| VK1-12_2_0_10 | CCTGAAGATTTTGCAACTTATTACTGTSWMCAGRNAAATAGTTTCCCTCCTTWCACTTTTGGCGGAGGGACCAAG | SWMCAGRNAAATAGTTTCCCTCCTTWCACT | 2797 | 3265 |
| VK1-12_3_0_10 | CCTGAAGATTTTGCAACTTATTACTGTSWMCAGGCANHCAGTTTCCCTCCTTWCACTTTTGGCGGAGGGACCAAG | SWMCAGGCANHCAGTTTCCCTCCTTWCACT | 2798 | 3266 |
| VK1-12_4_0_10 | CCTGAAGATTTTGCAACTTATTACTGTSWMCAGGCAAATNHCTTCCCTCCTTWCACTTTTGGCGGAGGGACCAAG | SWMCAGGCAAATNHCTTCCCTCCTTWCACT | 2799 | 3267 |
| VK1-12_5_0_10 | CCTGAAGATTTTGCAACTTATTACTGTSWMCAGGCAAATAGTYWCCCTCCTTWCACTTTTGGCGGAGGGACCAAG | SWMCAGGCAAATAGTYWCCCTCCTTWCACT | 2800 | 3268 |
| VK1-12_6_0_10 | CCTGAAGATTTTGCAACTTATTACTGTCAGSWMRNAAATAGTTTCCCTCCTTWCACTTTTGGCGGAGGGACCAAG | CAGSWMRNAAATAGTTTCCCTCCTTWCACT | 2801 | 3269 |
| VK1-12_7_0_10 | CCTGAAGATTTTGCAACTTATTACTGTCAGSWMGCANHCAGTTTCCCTCCTTWCACTTTTGGCGGAGGGACCAAG | CAGSWMGCANHCAGTTTCCCTCCTTWCACT | 2802 | 3270 |
| VK1-12_8_0_10 | CCTGAAGATTTTGCAACTTATTACTGTCAGSWMGCAAATNHCTTCCCTCCTTWCACTTTTGGCGGAGGGACCAAG | CAGSWMGCAAATNHCTTCCCTCCTTWCACT | 2803 | 3271 |
| VK1-12_9_0_10 | CCTGAAGATTTTGCAACTTATTACTGTCAGSWMGCAAATAGTYWCCCTCCTTWCACTTTTGGCGGAGGGACCAAG | CAGSWMGCAAATAGTYWCCCTCCTTWCACT | 2804 | 3272 |
| VK1-12_1_1_10 | CCTGAAGATTTTGCAACTTATTACTGTSWMSWMGCAAATAGTTTCCCTCCTMTCACTTTTGGCGGAGGGACCAAG | SWMSWMGCAAATAGTTTCCCTCCTMTCACT | 2805 | 3273 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_10_1_10 | CCTGAAGATTTTGCAACTTATTACTGTCAGCAGRNANHCAGTTTCCCTCCTMTCACTTTTGGCGGAGGGACCAAG | CAGCAGRNANHCAGTTTCCCTCCTMTCACT | 2806 | 3274 |
| VK1-12_11_1_10 | CCTGAAGATTTTGCAACTTATTACTGTCAGCAGRNAAATNHCTTCCCTCCTMTCACTTTTGGCGGAGGGACCAAG | CAGCAGRNAAATNHCTTCCCTCCTMTCACT | 2807 | 3275 |
| VK1-12_12_1_10 | CCTGAAGATTTTGCAACTTATTACTGTCAGCAGRNAAATAGTYWCCCTCCTMTCACTTTTGGCGGAGGGACCAAG | CAGCAGRNAAATAGTYWCCCTCCTMTCACT | 2808 | 3276 |
| VK1-12_13_1_10 | CCTGAAGATTTTGCAACTTATTACTGTCAGCAGGCANHCNHCTTCCCTCCTMTCACTTTTGGCGGAGGGACCAAG | CAGCAGGCANHCNHCTTCCCTCCTMTCACT | 2809 | 3277 |
| VK1-12_14_1_10 | CCTGAAGATTTTGCAACTTATTACTGTCAGCAGGCANHCAGTYWCCCTCCTMTCACTTTTGGCGGAGGGACCAAG | CAGCAGGCANHCAGTYWCCCTCCTMTCACT | 2810 | 3278 |
| VK1-12_15_1_10 | CCTGAAGATTTTGCAACTTATTACTGTCAGCAGGCAAATNHCYWCCCTCCTMTCACTTTTGGCGGAGGGACCAAG | CAGCAGGCAAATNHCYWCCCTCCTMTCACT | 2811 | 3279 |
| VK1-12_2_1_10 | CCTGAAGATTTTGCAACTTATTACTGTSWMCAGRNAAATAGTTTCCCTCCTMTCACTTTTGGCGGAGGGACCAAG | SWMCAGRNAAATAGTTTCCCTCCTMTCACT | 2812 | 3280 |
| VK1-12_3_1_10 | CCTGAAGATTTTGCAACTTATTACTGTSWMCAGGCANHCAGTTTCCCTCCTMTCACTTTTGGCGGAGGGACCAAG | SWMCAGGCANHCAGTTTCCCTCCTMTCACT | 2813 | 3281 |
| VK1-12_4_1_10 | CCTGAAGATTTTGCAACTTATTACTGTSWMCAGGCAAATNHCTTCCCTCCTMTCACTTTTGGCGGAGGGACCAAG | SWMCAGGCAAATNHCTTCCCTCCTMTCACT | 2814 | 3282 |
| VK1-12_5_1_10 | CCTGAAGATTTTGCAACTTATTACTGTSWMCAGGCAAATAGTYWCCCTCCTMTCACTTTTGGCGGAGGGACCAAG | SWMCAGGCAAATAGTYWCCCTCCTMTCACT | 2815 | 3283 |
| VK1-12_6_1_10 | CCTGAAGATTTTGCAACTTATTACTGTCAGSWMRNAAATAGTTTCCCTCCTMTCACTTTTGGCGGAGGGACCAAG | CAGSWMRNAAATAGTTTCCCTCCTMTCACT | 2816 | 3284 |
| VK1-12_7_1_10 | CCTGAAGATTTTGCAACTTATTACTGTCAGSWMGCANHCAGTTTCCCTCCTMTCACTTTTGGCGGAGGGACCAAG | CAGSWMGCANHCAGTTTCCCTCCTMTCACT | 2817 | 3285 |
| VK1-12_8_1_10 | CCTGAAGATTTTGCAACTTATTACTGTCAGSWMGCAAATNHCTTCCCTCCTMTCACTTTTGGCGGAGGGACCAAG | CAGSWMGCAAATNHCTTCCCTCCTMTCACT | 2818 | 3286 |
| VK1-12_9_1_10 | CCTGAAGATTTTGCAACTTATTACTGTCAGSWMGCAAATAGTYWCCCTCCTMTCACTTTTGGCGGAGGGACCAAG | CAGSWMGCAAATAGTYWCCCTCCTMTCACT | 2819 | 3287 |
| VK1-12_1_2_10 | CCTGAAGATTTTGCAACTTATTACTGTSWMSWMGCAAATAGTTTCCCTCCTWGGACTTTTGGCGGAGGGACCAAG | SWMSWMGCAAATAGTTTCCCTCCTWGGACT | 2820 | 3288 |
| VK1-12_10_2_10 | CCTGAAGATTTTGCAACTTATTACTGTCAGCAGRNANHCAGTTTCCCTCCTWGGACTTTTGGCGGAGGGACCAAG | CAGCAGRNANHCAGTTTCCCTCCTWGGACT | 2821 | 3289 |
| VK1-12_11_2_10 | CCTGAAGATTTTGCAACTTATTACTGTCAGCAGRNAAATNHCTTCCCTCCTWGGACTTTTGGCGGAGGGACCAAG | CAGCAGRNAAATNHCTTCCCTCCTWGGACT | 2822 | 3290 |
| VK1-12_12_2_10 | CCTGAAGATTTTGCAACTTATTACTGTCAGCAGRNAAATAGTYWCCCTCCTWGGACTTTTGGCGGAGGGACCAAG | CAGCAGRNAAATAGTYWCCCTCCTWGGACT | 2823 | 3291 |
| VK1-12_13_2_10 | CCTGAAGATTTTGCAACTTATTACTGTCAGCAGGCANHCNHCTTCCCTCCTWGGACTTTTGGCGGAGGGACCAAG | CAGCAGGCANHCNHCTTCCCTCCTWGGACT | 2824 | 3292 |
| VK1-12_14_2_10 | CCTGAAGATTTTGCAACTTATTACTGTCAGCAGGCANHCAGTYWCCCTCCTWGGACTTTTGGCGGAGGGACCAAG | CAGCAGGCANHCAGTYWCCCTCCTWGGACT | 2825 | 3293 |
| VK1-12_15_2_10 | CCTGAAGATTTTGCAACTTATTACTGTCAGCAGGCAAATNHCYWCCCTCCTWGGACTTTTGGCGGAGGGACCAAG | CAGCAGGCAAATNHCYWCCCTCCTWGGACT | 2826 | 3294 |
| VK1-12_2_2_10 | CCTGAAGATTTTGCAACTTATTACTGTSWMCAGRNAAATAGTTTCCCTCCTWGGACTTTTGGCGGAGGGACCAAG | SWMCAGRNAAATAGTTTCCCTCCTWGGACT | 2827 | 3295 |
| VK1-12_3_2_10 | CCTGAAGATTTTGCAACTTATTACTGTSWMCAGGCANHCAGTTTCCCTCCTWGGACTTTTGGCGGAGGGACCAAG | SWMCAGGCANHCAGTTTCCCTCCTWGGACT | 2828 | 3296 |
| VK1-12_4_2_10 | CCTGAAGATTTTGCAACTTATTACTGTSWMCAGGCAAATNHCTTCCCTCCTWGGACTTTTGGCGGAGGGACCAAG | SWMCAGGCAAATNHCTTCCCTCCTWGGACT | 2829 | 3297 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_5_2_10 | CCTGAAGATTTTGCAACTTATTACTGTSWMCAGGCAAATAGTYWCCCTCCTWGGACTTTTGGCGGAGGGACCAAG | SWMCAGGCAAATAGTYWCCCTCCTWGGACT | 2830 | 3298 |
| VK1-12_6_2_10 | CCTGAAGATTTTGCAACTTATTACTGTCAGSWMRNAAATAGTTTCCCTCCTWGGACTTTTGGCGGAGGGACCAAG | CAGSWMRNAAATAGTTTCCCTCCTWGGACT | 2831 | 3299 |
| VK1-12_7_2_10 | CCTGAAGATTTTGCAACTTATTACTGTCAGSWMGCANHCAGTTTCCCTCCTWGGACTTTTGGCGGAGGGACCAAG | CAGSWMGCANHCAGTTTCCCTCCTWGGACT | 2832 | 3300 |
| VK1-12_8_2_10 | CCTGAAGATTTTGCAACTTATTACTGTCAGSWMGCAAATNHCTTCCCTCCTWGGACTTTTGGCGGAGGGACCAAG | CAGSWMGCAAATNHCTTCCCTCCTWGGACT | 2833 | 3301 |
| VK1-12_9_2_10 | CCTGAAGATTTTGCAACTTATTACTGTCAGSWMGCAAATAGTYWCCCTCCTWGGACTTTTGGCGGAGGGACCAAG | CAGSWMGCAAATAGTYWCCCTCCTWGGACT | 2834 | 3302 |
| VK1-33_1_0_10 | CCTGAAGATATTGCAACATATTACTGTSWMSWMTACGATAATCTCCCTCCTTWCACTTTTGGCGGAGGGACCAAG | SWMSWMTACGATAATCTCCCTCCTTWCACT | 2835 | 3303 |
| VK1-33_10_0_10 | CCTGAAGATATTGCAACATATTACTGTCAGCAGBHCNHCAATCTCCCTCCTTWCACTTTTGGCGGAGGGACCAAG | CAGCAGBHCNHCAATCTCCCTCCTTWCACT | 2836 | 3304 |
| VK1-33_11_0_10 | CCTGAAGATATTGCAACATATTACTGTCAGCAGBHCGATNHCCTCCCTCCTTWCACTTTTGGCGGAGGGACCAAG | CAGCAGBHCGATNHCCTCCCTCCTTWCACT | 2837 | 3305 |
| VK1-33_12_0_10 | CCTGAAGATATTGCAACATATTACTGTCAGCAGBHCGATAATYWCCCTCCTTWCACTTTTGGCGGAGGGACCAAG | CAGCAGBHCGATAATYWCCCTCCTTWCACT | 2838 | 3306 |
| VK1-33_13_0_10 | CCTGAAGATATTGCAACATATTACTGTCAGCAGTACNHCNHCCTCCCTCCTTWCACTTTTGGCGGAGGGACCAAG | CAGCAGTACNHCNHCCTCCCTCCTTWCACT | 2839 | 3307 |
| VK1-33_14_0_10 | CCTGAAGATATTGCAACATATTACTGTCAGCAGTACNHCAATYWCCCTCCTTWCACTTTTGGCGGAGGGACCAAG | CAGCAGTACNHCAATYWCCCTCCTTWCACT | 2840 | 3308 |
| VK1-33_15_0_10 | CCTGAAGATATTGCAACATATTACTGTCAGCAGTACGATNHCYWCCCTCCTTWCACTTTTGGCGGAGGGACCAAG | CAGCAGTACGATNHCYWCCCTCCTTWCACT | 2841 | 3309 |
| VK1-33_2_0_10 | CCTGAAGATATTGCAACATATTACTGTSWMCAGBHCGATAATCTCCCTCCTTWCACTTTTGGCGGAGGGACCAAG | SWMCAGBHCGATAATCTCCCTCCTTWCACT | 2842 | 3310 |
| VK1-33_3_0_10 | CCTGAAGATATTGCAACATATTACTGTSWMCAGTACNHCAATCTCCCTCCTTWCACTTTTGGCGGAGGGACCAAG | SWMCAGTACNHCAATCTCCCTCCTTWCACT | 2843 | 3311 |
| VK1-33_4_0_10 | CCTGAAGATATTGCAACATATTACTGTSWMCAGTACGATNHCCTCCCTCCTTWCACTTTTGGCGGAGGGACCAAG | SWMCAGTACGATNHCCTCCCTCCTTWCACT | 2844 | 3312 |
| VK1-33_5_0_10 | CCTGAAGATATTGCAACATATTACTGTSWMCAGTACGATAATYWCCCTCCTTWCACTTTTGGCGGAGGGACCAAG | SWMCAGTACGATAATYWCCCTCCTTWCACT | 2845 | 3313 |
| VK1-33_6_0_10 | CCTGAAGATATTGCAACATATTACTGTCAGSWMBHCGATAATCTCCCTCCTTWCACTTTTGGCGGAGGGACCAAG | CAGSWMBHCGATAATCTCCCTCCTTWCACT | 2846 | 3314 |
| VK1-33_7_0_10 | CCTGAAGATATTGCAACATATTACTGTCAGSWMTACNHCAATCTCCCTCCTTWCACTTTTGGCGGAGGGACCAAG | CAGSWMTACNHCAATCTCCCTCCTTWCACT | 2847 | 3315 |
| VK1-33_8_0_10 | CCTGAAGATATTGCAACATATTACTGTCAGSWMTACGATNHCCTCCCTCCTTWCACTTTTGGCGGAGGGACCAAG | CAGSWMTACGATNHCCTCCCTCCTTWCACT | 2848 | 3316 |
| VK1-33_9_0_10 | CCTGAAGATATTGCAACATATTACTGTCAGSWMTACGATAATYWCCCTCCTTWCACTTTTGGCGGAGGGACCAAG | CAGSWMTACGATAATYWCCCTCCTTWCACT | 2849 | 3317 |
| VK1-33_1_1_10 | CCTGAAGATATTGCAACATATTACTGTSWMSWMTACGATAATCTCCCTCCTMTCACTTTTGGCGGAGGGACCAAG | SWMSWMTACGATAATCTCCCTCCTMTCACT | 2850 | 3318 |
| VK1-33_10_1_10 | CCTGAAGATATTGCAACATATTACTGTCAGCAGBHCNHCAATCTCCCTCCTMTCACTTTTGGCGGAGGGACCAAG | CAGCAGBHCNHCAATCTCCCTCCTMTCACT | 2851 | 3319 |
| VK1-33_11_1_10 | CCTGAAGATATTGCAACATATTACTGTCAGCAGBHCGATNHCCTCCCTCCTMTCACTTTTGGCGGAGGGACCAAG | CAGCAGBHCGATNHCCTCCCTCCTMTCACT | 2852 | 3320 |
| VK1-33_12_1_10 | CCTGAAGATATTGCAACATATTACTGTCAGCAGBHCGATAATYWCCCTCCTMTCACTTTTGGCGGAGGGACCAAG | CAGCAGBHCGATAATYWCCCTCCTMTCACT | 2853 | 3321 |
| VK1-33_13_1_10 | CCTGAAGATATTGCAACATATTACTGTCAGCAGTACNHCNHCCTCCCTCCTMTCACTTTTGGCGGAGGGACCAAG | CAGCAGTACNHCNHCCTCCCTCCTMTCACT | 2854 | 3322 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_14_1_10 | CCTGAAGATATTGCAACATATTACTGTCAGCAGTACNHCAATYWCCCTCCTMTCACTTTTGGCGGAGGGACCAAG | CAGCAGTACNHCAATYWCCCTCCTMTCACT | 2855 | 3323 |
| VK1-33_15_1_10 | CCTGAAGATATTGCAACATATTACTGTCAGCAGTACGATNHCYWCCCTCCTMTCACTTTTGGCGGAGGGACCAAG | CAGCAGTACGATNHCYWCCCTCCTMTCACT | 2856 | 3324 |
| VK1-33_2_1_10 | CCTGAAGATATTGCAACATATTACTGTSWMCAGBHCGATAATCTCCCTCCTMTCACTTTTGGCGGAGGGACCAAG | SWMCAGBHCGATAATCTCCCTCCTMTCACT | 2857 | 3325 |
| VK1-33_3_1_10 | CCTGAAGATATTGCAACATATTACTGTSWMCAGTACNHCAATCTCCCTCCTMTCACTTTTGGCGGAGGGACCAAG | SWMCAGTACNHCAATCTCCCTCCTMTCACT | 2858 | 3326 |
| VK1-33_4_1_10 | CCTGAAGATATTGCAACATATTACTGTSWMCAGTACGATNHCCTCCCTCCTMTCACTTTTGGCGGAGGGACCAAG | SWMCAGTACGATNHCCTCCCTCCTMTCACT | 2859 | 3327 |
| VK1-33_5_1_10 | CCTGAAGATATTGCAACATATTACTGTSWMCAGTACGATAATYWCCCTCCTMTCACTTTTGGCGGAGGGACCAAG | SWMCAGTACGATAATYWCCCTCCTMTCACT | 2860 | 3328 |
| VK1-33_6_1_10 | CCTGAAGATATTGCAACATATTACTGTCAGSWMBHCGATAATCTCCCTCCTMTCACTTTTGGCGGAGGGACCAAG | CAGSWMBHCGATAATCTCCCTCCTMTCACT | 2861 | 3329 |
| VK1-33_7_1_10 | CCTGAAGATATTGCAACATATTACTGTCAGSWMTACNHCAATCTCCCTCCTMTCACTTTTGGCGGAGGGACCAAG | CAGSWMTACNHCAATCTCCCTCCTMTCACT | 2862 | 3330 |
| VK1-33_8_1_10 | CCTGAAGATATTGCAACATATTACTGTCAGSWMTACGATNHCCTCCCTCCTMTCACTTTTGGCGGAGGGACCAAG | CAGSWMTACGATNHCCTCCCTCCTMTCACT | 2863 | 3331 |
| VK1-33_9_1_10 | CCTGAAGATATTGCAACATATTACTGTCAGSWMTACGATAATYWCCCTCCTMTCACTTTTGGCGGAGGGACCAAG | CAGSWMTACGATAATYWCCCTCCTMTCACT | 2864 | 3332 |
| VK1-33_1_2_10 | CCTGAAGATATTGCAACATATTACTGTSWMSWMTACGATAATCTCCCTCCTWGGACTTTTGGCGGAGGGACCAAG | SWMSWMTACGATAATCTCCCTCCTWGGACT | 2865 | 3333 |
| VK1-33_10_2_10 | CCTGAAGATATTGCAACATATTACTGTCAGCAGBHCNHCAATCTCCCTCCTWGGACTTTTGGCGGAGGGACCAAG | CAGCAGBHCNHCAATCTCCCTCCTWGGACT | 2866 | 3334 |
| VK1-33_11_2_10 | CCTGAAGATATTGCAACATATTACTGTCAGCAGBHCGATNHCCTCCCTCCTWGGACTTTTGGCGGAGGGACCAAG | CAGCAGBHCGATNHCCTCCCTCCTWGGACT | 2867 | 3335 |
| VK1-33_12_2_10 | CCTGAAGATATTGCAACATATTACTGTCAGCAGBHCGATAATYWCCCTCCTWGGACTTTTGGCGGAGGGACCAAG | CAGCAGBHCGATAATYWCCCTCCTWGGACT | 2868 | 3336 |
| VK1-33_13_2_10 | CCTGAAGATATTGCAACATATTACTGTCAGCAGTACNHCNHCCTCCCTCCTWGGACTTTTGGCGGAGGGACCAAG | CAGCAGTACNHCNHCCTCCCTCCTWGGACT | 2869 | 3337 |
| VK1-33_14_2_10 | CCTGAAGATATTGCAACATATTACTGTCAGCAGTACNHCAATYWCCCTCCTWGGACTTTTGGCGGAGGGACCAAG | CAGCAGTACNHCAATYWCCCTCCTWGGACT | 2870 | 3338 |
| VK1-33_15_2_10 | CCTGAAGATATTGCAACATATTACTGTCAGCAGTACGATNHCYWCCCTCCTWGGACTTTTGGCGGAGGGACCAAG | CAGCAGTACGATNHCYWCCCTCCTWGGACT | 2871 | 3339 |
| VK1-33_2_2_10 | CCTGAAGATATTGCAACATATTACTGTSWMCAGBHCGATAATCTCCCTCCTWGGACTTTTGGCGGAGGGACCAAG | SWMCAGBHCGATAATCTCCCTCCTWGGACT | 2872 | 3340 |
| VK1-33_3_2_10 | CCTGAAGATATTGCAACATATTACTGTSWMCAGTACNHCAATCTCCCTCCTWGGACTTTTGGCGGAGGGACCAAG | SWMCAGTACNHCAATCTCCCTCCTWGGACT | 2873 | 3341 |
| VK1-33_4_2_10 | CCTGAAGATATTGCAACATATTACTGTSWMCAGTACGATNHCCTCCCTCCTWGGACTTTTGGCGGAGGGACCAAG | SWMCAGTACGATNHCCTCCCTCCTWGGACT | 2874 | 3342 |
| VK1-33_5_2_10 | CCTGAAGATATTGCAACATATTACTGTSWMCAGTACGATAATYWCCCTCCTWGGACTTTTGGCGGAGGGACCAAG | SWMCAGTACGATAATYWCCCTCCTWGGACT | 2875 | 3343 |
| VK1-33_6_2_10 | CCTGAAGATATTGCAACATATTACTGTCAGSWMBHCGATAATCTCCCTCCTWGGACTTTTGGCGGAGGGACCAAG | CAGSWMBHCGATAATCTCCCTCCTWGGACT | 2876 | 3344 |
| VK1-33_7_2_10 | CCTGAAGATATTGCAACATATTACTGTCAGSWMTACNHCAATCTCCCTCCTWGGACTTTTGGCGGAGGGACCAAG | CAGSWMTACNHCAATCTCCCTCCTWGGACT | 2877 | 3345 |
| VK1-33_8_2_10 | CCTGAAGATATTGCAACATATTACTGTCAGSWMTACGATNHCCTCCCTCCTWGGACTTTTGGCGGAGGGACCAAG | CAGSWMTACGATNHCCTCCCTCCTWGGACT | 2878 | 3346 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-33_9_2_10 | CCTGAAGATATTGCAACATATTACTGTCAGSWMTACGATAATYWCCCTCCTWGGACTTTTGGCGGAGGGACCAAG | CAGSWMTACGATAATYWCCCTCCTWGGACT | 2879 | 3347 |
| VK1-39_1_0_10 | CCTGAAGATTTTGCAACTTACTACTGTSWMSWMAGCTACAGTACTCCTCCTTWCACTTTTGGCGGAGGGACCAAG | SWMSWMAGCTACAGTACTCCTCCTTWCACT | 2880 | 3348 |
| VK1-39_10_0_10 | CCTGAAGATTTTGCAACTTACTACTGTCAGCAAVNABHCAGTACTCCTCCTTWCACTTTTGGCGGAGGGACCAAG | CAGCAAVNABHCAGTACTCCTCCTTWCACT | 2881 | 3349 |
| VK1-39_11_0_10 | CCTGAAGATTTTGCAACTTACTACTGTCAGCAAVNATACNHCACTCCTCCTTWCACTTTTGGCGGAGGGACCAAG | CAGCAAVNATACNHCACTCCTCCTTWCACT | 2882 | 3350 |
| VK1-39_12_0_10 | CCTGAAGATTTTGCAACTTACTACTGTCAGCAAVNATACAGTBHCCCTCCTTWCACTTTTGGCGGAGGGACCAAG | CAGCAAVNATACAGTBHCCCTCCTTWCACT | 2883 | 3351 |
| VK1-39_13_0_10 | CCTGAAGATTTTGCAACTTACTACTGTCAGCAAAGCBHCNHCACTCCTCCTTWCACTTTTGGCGGAGGGACCAAG | CAGCAAAGCBHCNHCACTCCTCCTTWCACT | 2884 | 3352 |
| VK1-39_14_0_10 | CCTGAAGATTTTGCAACTTACTACTGTCAGCAAAGCBHCAGTBHCCCTCCTTWCACTTTTGGCGGAGGGACCAAG | CAGCAAAGCBHCAGTBHCCCTCCTTWCACT | 2885 | 3353 |
| VK1-39_15_0_10 | CCTGAAGATTTTGCAACTTACTACTGTCAGCAAAGCTACNHCBHCCCTCCTTWCACTTTTGGCGGAGGGACCAAG | CAGCAAAGCTACNHCBHCCCTCCTTWCACT | 2886 | 3354 |
| VK1-39_2_0_10 | CCTGAAGATTTTGCAACTTACTACTGTSWMCAAVNATACAGTACTCCTCCTTWCACTTTTGGCGGAGGGACCAAG | SWMCAAVNATACAGTACTCCTCCTTWCACT | 2887 | 3355 |
| VK1-39_3_0_10 | CCTGAAGATTTTGCAACTTACTACTGTSWMCAAAGCBHCAGTACTCCTCCTTWCACTTTTGGCGGAGGGACCAAG | SWMCAAAGCBHCAGTACTCCTCCTTWCACT | 2888 | 3356 |
| VK1-39_4_0_10 | CCTGAAGATTTTGCAACTTACTACTGTSWMCAAAGCTACNHCACTCCTCCTTWCACTTTTGGCGGAGGGACCAAG | SWMCAAAGCTACNHCACTCCTCCTTWCACT | 2889 | 3357 |
| VK1-39_5_0_10 | CCTGAAGATTTTGCAACTTACTACTGTSWMCAAAGCTACAGTBHCCCTCCTTWCACTTTTGGCGGAGGGACCAAG | SWMCAAAGCTACAGTBHCCCTCCTTWCACT | 2890 | 3358 |
| VK1-39_6_0_10 | CCTGAAGATTTTGCAACTTACTACTGTCAGSWMVNATACAGTACTCCTCCTTWCACTTTTGGCGGAGGGACCAAG | CAGSWMVNATACAGTACTCCTCCTTWCACT | 2891 | 3359 |
| VK1-39_7_0_10 | CCTGAAGATTTTGCAACTTACTACTGTCAGSWMAGCBHCAGTACTCCTCCTTWCACTTTTGGCGGAGGGACCAAG | CAGSWMAGCBHCAGTACTCCTCCTTWCACT | 2892 | 3360 |
| VK1-39_8_0_10 | CCTGAAGATTTTGCAACTTACTACTGTCAGSWMAGCTACNHCACTCCTCCTTWCACTTTTGGCGGAGGGACCAAG | CAGSWMAGCTACNHCACTCCTCCTTWCACT | 2893 | 3361 |
| VK1-39_9_0_10 | CCTGAAGATTTTGCAACTTACTACTGTCAGSWMAGCTACAGTBHCCCTCCTTWCACTTTTGGCGGAGGGACCAAG | CAGSWMAGCTACAGTBHCCCTCCTTWCACT | 2894 | 3362 |
| VK1-39_1_1_10 | CCTGAAGATTTTGCAACTTACTACTGTSWMSWMAGCTACAGTACTCCTCCTMTCACTTTTGGCGGAGGGACCAAG | SWMSWMAGCTACAGTACTCCTCCTMTCACT | 2895 | 3363 |
| VK1-39_10_1_10 | CCTGAAGATTTTGCAACTTACTACTGTCAGCAAVNABHCAGTACTCCTCCTMTCACTTTTGGCGGAGGGACCAAG | CAGCAAVNABHCAGTACTCCTCCTMTCACT | 2896 | 3364 |
| VK1-39_11_1_10 | CCTGAAGATTTTGCAACTTACTACTGTCAGCAAVNATACNHCACTCCTCCTMTCACTTTTGGCGGAGGGACCAAG | CAGCAAVNATACNHCACTCCTCCTMTCACT | 2897 | 3365 |
| VK1-39_12_1_10 | CCTGAAGATTTTGCAACTTACTACTGTCAGCAAVNATACAGTBHCCCTCCTMTCACTTTTGGCGGAGGGACCAAG | CAGCAAVNATACAGTBHCCCTCCTMTCACT | 2898 | 3366 |
| VK1-39_13_1_10 | CCTGAAGATTTTGCAACTTACTACTGTCAGCAAAGCBHCNHCACTCCTCCTMTCACTTTTGGCGGAGGGACCAAG | CAGCAAAGCBHCNHCACTCCTCCTMTCACT | 2899 | 3367 |
| VK1-39_14_1_10 | CCTGAAGATTTTGCAACTTACTACTGTCAGCAAAGCBHCAGTBHCCCTCCTMTCACTTTTGGCGGAGGGACCAAG | CAGCAAAGCBHCAGTBHCCCTCCTMTCACT | 2900 | 3368 |
| VK1-39_15_1_10 | CCTGAAGATTTTGCAACTTACTACTGTCAGCAAAGCTACNHCBHCCCTCCTMTCACTTTTGGCGGAGGGACCAAG | CAGCAAAGCTACNHCBHCCCTCCTMTCACT | 2901 | 3369 |
| VK1-39_2_1_10 | CCTGAAGATTTTGCAACTTACTACTGTSWMCAAVNATACAGTACTCCTCCTMTCACTTTTGGCGGAGGGACCAAG | SWMCAAVNATACAGTACTCCTCCTMTCACT | 2902 | 3370 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_3_1_10 | CCTGAAGATTTTGCAACTTACTACTGTSWMCAAAGCBHCAGTACTCCTCCTMTCACTTTTGGCGGAGGGACCAAG | SWMCAAAGCBHCAGTACTCCTCCTMTCACT | 2903 | 3371 |
| VK1-39_4_1_10 | CCTGAAGATTTTGCAACTTACTACTGTSWMCAAAGCTACNHCACTCCTCCTMTCACTTTTGGCGGAGGGACCAAG | SWMCAAAGCTACNHCACTCCTCCTMTCACT | 2904 | 3372 |
| VK1-39_5_1_10 | CCTGAAGATTTTGCAACTTACTACTGTSWMCAAAGCTACAGTBHCCCTCCTMTCACTTTTGGCGGAGGGACCAAG | SWMCAAAGCTACAGTBHCCCTCCTMTCACT | 2905 | 3373 |
| VK1-39_6_1_10 | CCTGAAGATTTTGCAACTTACTACTGTCAGSWMVNATACAGTACTCCTCCTMTCACTTTTGGCGGAGGGACCAAG | CAGSWMVNATACAGTACTCCTCCTMTCACT | 2906 | 3374 |
| VK1-39_7_1_10 | CCTGAAGATTTTGCAACTTACTACTGTCAGSWMAGCBHCAGTACTCCTCCTMTCACTTTTGGCGGAGGGACCAAG | CAGSWMAGCBHCAGTACTCCTCCTMTCACT | 2907 | 3375 |
| VK1-39_8_1_10 | CCTGAAGATTTTGCAACTTACTACTGTCAGSWMAGCTACNHCACTCCTCCTMTCACTTTTGGCGGAGGGACCAAG | CAGSWMAGCTACNHCACTCCTCCTMTCACT | 2908 | 3376 |
| VK1-39_9_1_10 | CCTGAAGATTTTGCAACTTACTACTGTCAGSWMAGCTACAGTBHCCCTCCTMTCACTTTTGGCGGAGGGACCAAG | CAGSWMAGCTACAGTBHCCCTCCTMTCACT | 2909 | 3377 |
| VK1-39_1_2_10 | CCTGAAGATTTTGCAACTTACTACTGTSWMSWMAGCTACAGTACTCCTCCTWGGACTTTTGGCGGAGGGACCAAG | SWMSWMAGCTACAGTACTCCTCCTWGGACT | 2910 | 3378 |
| VK1-39_10_2_10 | CCTGAAGATTTTGCAACTTACTACTGTCAGCAAVNABHCAGTACTCCTCCTWGGACTTTTGGCGGAGGGACCAAG | CAGCAAVNABHCAGTACTCCTCCTWGGACT | 2911 | 3379 |
| VK1-39_11_2_10 | CCTGAAGATTTTGCAACTTACTACTGTCAGCAAVNATACNHCACTCCTCCTWGGACTTTTGGCGGAGGGACCAAG | CAGCAAVNATACNHCACTCCTCCTWGGACT | 2912 | 3380 |
| VK1-39_12_2_10 | CCTGAAGATTTTGCAACTTACTACTGTCAGCAAVNATACAGTBHCCCTCCTWGGACTTTTGGCGGAGGGACCAAG | CAGCAAVNATACAGTBHCCCTCCTWGGACT | 2913 | 3381 |
| VK1-39_13_2_10 | CCTGAAGATTTTGCAACTTACTACTGTCAGCAAAGCBHCNHCACTCCTCCTWGGACTTTTGGCGGAGGGACCAAG | CAGCAAAGCBHCNHCACTCCTCCTWGGACT | 2914 | 3382 |
| VK1-39_14_2_10 | CCTGAAGATTTTGCAACTTACTACTGTCAGCAAAGCBHCAGTBHCCCTCCTWGGACTTTTGGCGGAGGGACCAAG | CAGCAAAGCBHCAGTBHCCCTCCTWGGACT | 2915 | 3383 |
| VK1-39_15_2_10 | CCTGAAGATTTTGCAACTTACTACTGTCAGCAAAGCTACNHCBHCCCTCCTWGGACTTTTGGCGGAGGGACCAAG | CAGCAAAGCTACNHCBHCCCTCCTWGGACT | 2916 | 3384 |
| VK1-39_2_2_10 | CCTGAAGATTTTGCAACTTACTACTGTSWMCAAVNATACAGTACTCCTCCTWGGACTTTTGGCGGAGGGACCAAG | SWMCAAVNATACAGTACTCCTCCTWGGACT | 2917 | 3385 |
| VK1-39_3_2_10 | CCTGAAGATTTTGCAACTTACTACTGTSWMCAAAGCBHCAGTACTCCTCCTWGGACTTTTGGCGGAGGGACCAAG | SWMCAAAGCBHCAGTACTCCTCCTWGGACT | 2918 | 3386 |
| VK1-39_4_2_10 | CCTGAAGATTTTGCAACTTACTACTGTSWMCAAAGCTACNHCACTCCTCCTWGGACTTTTGGCGGAGGGACCAAG | SWMCAAAGCTACNHCACTCCTCCTWGGACT | 2919 | 3387 |
| VK1-39_5_2_10 | CCTGAAGATTTTGCAACTTACTACTGTSWMCAAAGCTACAGTBHCCCTCCTWGGACTTTTGGCGGAGGGACCAAG | SWMCAAAGCTACAGTBHCCCTCCTWGGACT | 2920 | 3388 |
| VK1-39_6_2_10 | CCTGAAGATTTTGCAACTTACTACTGTCAGSWMVNATACAGTACTCCTCCTWGGACTTTTGGCGGAGGGACCAAG | CAGSWMVNATACAGTACTCCTCCTWGGACT | 2921 | 3389 |
| VK1-39_7_2_10 | CCTGAAGATTTTGCAACTTACTACTGTCAGSWMAGCBHCAGTACTCCTCCTWGGACTTTTGGCGGAGGGACCAAG | CAGSWMAGCBHCAGTACTCCTCCTWGGACT | 2922 | 3390 |
| VK1-39_8_2_10 | CCTGAAGATTTTGCAACTTACTACTGTCAGSWMAGCTACNHCACTCCTCCTWGGACTTTTGGCGGAGGGACCAAG | CAGSWMAGCTACNHCACTCCTCCTWGGACT | 2923 | 3391 |
| VK1-39_9_2_10 | CCTGAAGATTTTGCAACTTACTACTGTCAGSWMAGCTACAGTBHCCCTCCTWGGACTTTTGGCGGAGGGACCAAG | CAGSWMAGCTACAGTBHCCCTCCTWGGACT | 2924 | 3392 |
| VK2-28_1_0_10 | GCTGAGGATGTTGGGGTTTATTACTGCDTSSWMGCACTCCAGACTCCTCCTTWCACTTTTGGCGGAGGGACCAAG | DTSSWMGCACTCCAGACTCCTCCTTWCACT | 2925 | 3393 |
| VK2-28_10_0_10 | GCTGAGGATGTTGGGGTTTATTACTGCATGCAGVNAMNACAGACTCCTCCTTWCACTTTTGGCGGAGGGACCAAG | ATGCAGVNAMNACAGACTCCTCCTTWCACT | 2926 | 3394 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_11_0_10 | GCTGAGGATGTTGGGGTTTATTACTGCATGCAGVNACTCSR MACTCCTCCTTWCACTTTTGGCGGAGGGACCAAG | ATGCAGVNACTCSRMACTCC TCCTTWCACT | 2927 | 3395 |
| VK2-28_12_0_10 | GCTGAGGATGTTGGGGTTTATTACTGCATGCAGVNACTCCA GVBCCCTCCTTWCACTTTTGGCGGAGGGACCAAG | ATGCAGVNACTCCAGVBCCC TCCTTWCACT | 2928 | 3396 |
| VK2-28_13_0_10 | GCTGAGGATGTTGGGGTTTATTACTGCATGCAGGCAMNASR MACTCCTCCTTWCACTTTTGGCGGAGGGACCAAG | ATGCAGGCAMNASRMACTCC TCCTTWCACT | 2929 | 3397 |
| VK2-28_14_0_10 | GCTGAGGATGTTGGGGTTTATTACTGCATGCAGGCAMNACA GVBCCCTCCTTWCACTTTTGGCGGAGGGACCAAG | ATGCAGGCAMNACAGVBCCC TCCTTWCACT | 2930 | 3398 |
| VK2-28_15_0_10 | GCTGAGGATGTTGGGGTTTATTACTGCATGCAGGCACTCSR MVBCCCTCCTTWCACTTTTGGCGGAGGGACCAAG | ATGCAGGCACTCSRMVBCCC TCCTTWCACT | 2931 | 3399 |
| VK2-28_2_0_10 | GCTGAGGATGTTGGGGTTTATTACTGCDTSCAGVNACTCCA GACTCCTCCTTWCACTTTTGGCGGAGGGACCAAG | DTSCAGVNACTCCAGACTCC TCCTTWCACT | 2932 | 3400 |
| VK2-28_3_0_10 | GCTGAGGATGTTGGGGTTTATTACTGCDTSCAGGCAMNACA GACTCCTCCTTWCACTTTTGGCGGAGGGACCAAG | DTSCAGGCAMNACAGACTCC TCCTTWCACT | 2933 | 3401 |
| VK2-28_4_0_10 | GCTGAGGATGTTGGGGTTTATTACTGCDTSCAGGCACTCSR MACTCCTCCTTWCACTTTTGGCGGAGGGACCAAG | DTSCAGGCACTCSRMACTCC TCCTTWCACT | 2934 | 3402 |
| VK2-28_5_0_10 | GCTGAGGATGTTGGGGTTTATTACTGCDTSCAGGCACTCCA GVBCCCTCCTTWCACTTTTGGCGGAGGGACCAAG | DTSCAGGCACTCCAGVBCCC TCCTTWCACT | 2935 | 3403 |
| VK2-28_6_0_10 | GCTGAGGATGTTGGGGTTTATTACTGCATGSWMVNACTCCA GACTCCTCCTTWCACTTTTGGCGGAGGGACCAAG | ATGSWMVNACTCCAGACTCC TCCTTWCACT | 2936 | 3404 |
| VK2-28_7_0_10 | GCTGAGGATGTTGGGGTTTATTACTGCATGSWMGCAMNACA GACTCCTCCTTWCACTTTTGGCGGAGGGACCAAG | ATGSWMGCAMNACAGACTCC TCCTTWCACT | 2937 | 3405 |
| VK2-28_8_0_10 | GCTGAGGATGTTGGGGTTTATTACTGCATGSWMGCACTCSR MACTCCTCCTTWCACTTTTGGCGGAGGGACCAAG | ATGSWMGCACTCSRMACTCC TCCTTWCACT | 2938 | 3406 |
| VK2-28_9_0_10 | GCTGAGGATGTTGGGGTTTATTACTGCATGSWMGCACTCCA GVBCCCTCCTTWCACTTTTGGCGGAGGGACCAAG | ATGSWMGCACTCCAGVBCCC TCCTTWCACT | 2939 | 3407 |
| VK2-28_1_1_10 | GCTGAGGATGTTGGGGTTTATTACTGCDTSSWMGCACTCCA GACTCCTCCTMTCACTTTTGGCGGAGGGACCAAG | DTSSWMGCACTCCAGACTCC TCCTMTCACT | 2940 | 3408 |
| VK2-28_10_1_10 | GCTGAGGATGTTGGGGTTTATTACTGCATGCAGVNAMNACA GACTCCTCCTMTCACTTTTGGCGGAGGGACCAAG | ATGCAGVNAMNACAGACTCC TCCTMTCACT | 2941 | 3409 |
| VK2-28_11_1_10 | GCTGAGGATGTTGGGGTTTATTACTGCATGCAGVNACTCSR MACTCCTCCTMTCACTTTTGGCGGAGGGACCAAG | ATGCAGVNACTCSRMACTCC TCCTMTCACT | 2942 | 3410 |
| VK2-28_12_1_10 | GCTGAGGATGTTGGGGTTTATTACTGCATGCAGVNACTCCA GVBCCCTCCTMTCACTTTTGGCGGAGGGACCAAG | ATGCAGVNACTCCAGVBCCC TCCTMTCACT | 2943 | 3411 |
| VK2-28_13_1_10 | GCTGAGGATGTTGGGGTTTATTACTGCATGCAGGCAMNASR MACTCCTCCTMTCACTTTTGGCGGAGGGACCAAG | ATGCAGGCAMNASRMACTCC TCCTMTCACT | 2944 | 3412 |
| VK2-28_14_1_10 | GCTGAGGATGTTGGGGTTTATTACTGCATGCAGGCAMNACA GVBCCCTCCTMTCACTTTTGGCGGAGGGACCAAG | ATGCAGGCAMNACAGVBCCC TCCTMTCACT | 2945 | 3413 |
| VK2-28_15_1_10 | GCTGAGGATGTTGGGGTTTATTACTGCATGCAGGCACTCSR MVBCCCTCCTMTCACTTTTGGCGGAGGGACCAAG | ATGCAGGCACTCSRMVBCCC TCCTMTCACT | 2946 | 3414 |
| VK2-28_2_1_10 | GCTGAGGATGTTGGGGTTTATTACTGCDTSCAGVNACTCCA GACTCCTCCTMTCACTTTTGGCGGAGGGACCAAG | DTSCAGVNACTCCAGACTCC TCCTMTCACT | 2947 | 3415 |
| VK2-28_3_1_10 | GCTGAGGATGTTGGGGTTTATTACTGCDTSCAGGCAMNACA GACTCCTCCTMTCACTTTTGGCGGAGGGACCAAG | DTSCAGGCAMNACAGACTCC TCCTMTCACT | 2948 | 3416 |
| VK2-28_4_1_10 | GCTGAGGATGTTGGGGTTTATTACTGCDTSCAGGCACTCSR MACTCCTCCTMTCACTTTTGGCGGAGGGACCAAG | DTSCAGGCACTCSRMACTCC TCCTMTCACT | 2949 | 3417 |
| VK2-28_5_1_10 | GCTGAGGATGTTGGGGTTTATTACTGCDTSCAGGCACTCCA GVBCCCTCCTMTCACTTTTGGCGGAGGGACCAAG | DTSCAGGCACTCCAGVBCCC TCCTMTCACT | 2950 | 3418 |
| VK2-28_6_1_10 | GCTGAGGATGTTGGGGTTTATTACTGCATGSWMVNACTCCA GACTCCTCCTMTCACTTTTGGCGGAGGGACCAAG | ATGSWMVNACTCCAGACTCC TCCTMTCACT | 2951 | 3419 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK2-28_7_1_10 | GCTGAGGATGTTGGGGTTTATTACTGCATGSWMGCAMNACAGACTCCTCCTMTCACTTTTGGCGGAGGGACCAAG | ATGSWMGCAMNACAGACTCCTCCTMTCACT | 2952 | 3420 |
| VK2-28_8_1_10 | GCTGAGGATGTTGGGGTTTATTACTGCATGSWMGCACTCSRMACTCCTCCTMTCACTTTTGGCGGAGGGACCAAG | ATGSWMGCACTCSRMACTCCTCCTMTCACT | 2953 | 3421 |
| VK2-28_9_1_10 | GCTGAGGATGTTGGGGTTTATTACTGCATGSWMGCACTCCAGVBCCCTCCTMTCACTTTTGGCGGAGGGACCAAG | ATGSWMGCACTCCAGVBCCCTCCTMTCACT | 2954 | 3422 |
| VK2-28_1_2_10 | GCTGAGGATGTTGGGGTTTATTACTGCDTSSWMGCACTCCAGACTCCTCCTWGGACTTTTGGCGGAGGGACCAAG | DTSSWMGCACTCCAGACTCCTCCTWGGACT | 2955 | 3423 |
| VK2-28_10_2_10 | GCTGAGGATGTTGGGGTTTATTACTGCATGCAGVNAMNACAGACTCCTCCTWGGACTTTTGGCGGAGGGACCAAG | ATGCAGVNAMNACAGACTCCTCCTWGGACT | 2956 | 3424 |
| VK2-28_11_2_10 | GCTGAGGATGTTGGGGTTTATTACTGCATGCAGVNACTCSRMACTCCTCCTWGGACTTTTGGCGGAGGGACCAAG | ATGCAGVNACTCSRMACTCCTCCTWGGACT | 2957 | 3425 |
| VK2-28_12_2_10 | GCTGAGGATGTTGGGGTTTATTACTGCATGCAGVNACTCCAGVBCCCTCCTWGGACTTTTGGCGGAGGGACCAAG | ATGCAGVNACTCCAGVBCCCTCCTWGGACT | 2958 | 3426 |
| VK2-28_13_2_10 | GCTGAGGATGTTGGGGTTTATTACTGCATGCAGGCAMNASRMACTCCTCCTWGGACTTTTGGCGGAGGGACCAAG | ATGCAGGCAMNASRMACTCCTCCTWGGACT | 2959 | 3427 |
| VK2-28_14_2_10 | GCTGAGGATGTTGGGGTTTATTACTGCATGCAGGCAMNACAGVBCCCTCCTWGGACTTTTGGCGGAGGGACCAAG | ATGCAGGCAMNACAGVBCCCTCCTWGGACT | 2960 | 3428 |
| VK2-28_15_2_10 | GCTGAGGATGTTGGGGTTTATTACTGCATGCAGGCACTCSRMVBCCCTCCTWGGACTTTTGGCGGAGGGACCAAG | ATGCAGGCACTCSRMVBCCCTCCTWGGACT | 2961 | 3429 |
| VK2-28_2_2_10 | GCTGAGGATGTTGGGGTTTATTACTGCDTSCAGVNACTCCAGACTCCTCCTWGGACTTTTGGCGGAGGGACCAAG | DTSCAGVNACTCCAGACTCCTCCTWGGACT | 2962 | 3430 |
| VK2-28_3_2_10 | GCTGAGGATGTTGGGGTTTATTACTGCDTSCAGGCAMNACAGACTCCTCCTWGGACTTTTGGCGGAGGGACCAAG | DTSCAGGCAMNACAGACTCCTCCTWGGACT | 2963 | 3431 |
| VK2-28_4_2_10 | GCTGAGGATGTTGGGGTTTATTACTGCDTSCAGGCACTCSRMACTCCTCCTWGGACTTTTGGCGGAGGGACCAAG | DTSCAGGCACTCSRMACTCCTCCTWGGACT | 2964 | 3432 |
| VK2-28_5_2_10 | GCTGAGGATGTTGGGGTTTATTACTGCDTSCAGGCACTCCAGVBCCCTCCTWGGACTTTTGGCGGAGGGACCAAG | DTSCAGGCACTCCAGVBCCCTCCTWGGACT | 2965 | 3433 |
| VK2-28_6_2_10 | GCTGAGGATGTTGGGGTTTATTACTGCATGSWMVNACTCCAGACTCCTCCTWGGACTTTTGGCGGAGGGACCAAG | ATGSWMVNACTCCAGACTCCTCCTWGGACT | 2966 | 3434 |
| VK2-28_7_2_10 | GCTGAGGATGTTGGGGTTTATTACTGCATGSWMGCAMNACAGACTCCTCCTWGGACTTTTGGCGGAGGGACCAAG | ATGSWMGCAMNACAGACTCCTCCTWGGACT | 2967 | 3435 |
| VK2-28_8_2_10 | GCTGAGGATGTTGGGGTTTATTACTGCATGSWMGCACTCSRMACTCCTCCTWGGACTTTTGGCGGAGGGACCAAG | ATGSWMGCACTCSRMACTCCTCCTWGGACT | 2968 | 3436 |
| VK2-28_9_2_10 | GCTGAGGATGTTGGGGTTTATTACTGCATGSWMGCACTCCAGVBCCCTCCTWGGACTTTTGGCGGAGGGACCAAG | ATGSWMGCACTCCAGVBCCCTCCTWGGACT | 2969 | 3437 |
| VK3-11_1_0_10 | CCTGAAGATTTTGCAGTTTATTACTGTSWMSWMAGAAGTAATTGGCCTTGGCCTCCTTWCACTTTTGGCGGAGGGACCAAG | SWMSWMAGAAGTAATTGGCCTCCTTWCACT | 2970 | 3438 |
| VK3-11_10_0_10 | CCTGAAGATTTTGCAGTTTATTACTGTCAGCAGBHCNHCAATTGGCCTCCTTWCACTTTTGGCGGAGGGACCAAG | CAGCAGBHCNHCAATTGGCCTCCTTWCACT | 2971 | 3439 |
| VK3-11_11_0_10 | CCTGAAGATTTTGCAGTTTATTACTGTCAGCAGBHCAGTNHCTGGCCTCCTTWCACTTTTGGCGGAGGGACCAAG | CAGCAGBHCAGTNHCTGGCCTCCTTWCACT | 2972 | 3440 |
| VK3-11_12_0_10 | CCTGAAGATTTTGCAGTTTATTACTGTCAGCAGBHCAGTAATYWCCCTCCTTWCACTTTTGGCGGAGGGACCAAG | CAGCAGBHCAGTAATYWCCCTCCTTWCACT | 2973 | 3441 |
| VK3-11_13_0_10 | CCTGAAGATTTTGCAGTTTATTACTGTCAGCAGAGANHCNHCTGGCCTCCTTWCACTTTTGGCGGAGGGACCAAG | CAGCAGAGANHCNHCTGGCCTCCTTWCACT | 2974 | 3442 |
| VK3-11_14_0_10 | CCTGAAGATTTTGCAGTTTATTACTGTCAGCAGAGANHCAATYWCCCTCCTTWCACTTTTGGCGGAGGGACCAAG | CAGCAGAGANHCAATYWCCCTCCTTWCACT | 2975 | 3443 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_15_0_10 | CCTGAAGATTTTGCAGTTTATTACTGTCAGCAGAGAAGTNH CYWCCCTCCTTWCACTTTTGGCGGAGGGACCAAG | CAGCAGAGAAGTNHCYWCCC TCCTTWCACT | 2976 | 3444 |
| VK3-11_2_0_10 | CCTGAAGATTTTGCAGTTTATTACTGTSWMCAGBHCAGTAA TTGGCCTCCTTWCACTTTTGGCGGAGGGACCAAG | SWMCAGBHCAGTAATTGGCC TCCTTWCACT | 2977 | 3445 |
| VK3-11_3_0_10 | CCTGAAGATTTTGCAGTTTATTACTGTSWMCAGAGANHCAA TTGGCCTCCTTWCACTTTTGGCGGAGGGACCAAG | SWMCAGAGANHCAATTGGCC TCCTTWCACT | 2978 | 3446 |
| VK3-11_4_0_10 | CCTGAAGATTTTGCAGTTTATTACTGTSWMCAGAGAAGTNH CTGGCCTCCTTWCACTTTTGGCGGAGGGACCAAG | SWMCAGAGAAGTNHCTGGCC TCCTTWCACT | 2979 | 3447 |
| VK3-11_5_0_10 | CCTGAAGATTTTGCAGTTTATTACTGTSWMCAGAGAAGTAA TYWCCCTCCTTWCACTTTTGGCGGAGGGACCAAG | SWMCAGAGAAGTAATYWCCC TCCTTWCACT | 2980 | 3448 |
| VK3-11_6_0_10 | CCTGAAGATTTTGCAGTTTATTACTGTCAGSWMBHCAGTAA TTGGCCTCCTTWCACTTTTGGCGGAGGGACCAAG | CAGSWMBHCAGTAATTGGCC TCCTTWCACT | 2981 | 3449 |
| VK3-11_7_0_10 | CCTGAAGATTTTGCAGTTTATTACTGTCAGSWMAGANHCAA TTGGCCTCCTTWCACTTTTGGCGGAGGGACCAAG | CAGSWMAGANHCAATTGGCC TCCTTWCACT | 2982 | 3450 |
| VK3-11_8_0_10 | CCTGAAGATTTTGCAGTTTATTACTGTCAGSWMAGAAGTNH CTGGCCTCCTTWCACTTTTGGCGGAGGGACCAAG | CAGSWMAGAAGTNHCTGGCC TCCTTWCACT | 2983 | 3451 |
| VK3-11_9_0_10 | CCTGAAGATTTTGCAGTTTATTACTGTCAGSWMAGAAGTAA TYWCCCTCCTTWCACTTTTGGCGGAGGGACCAAG | CAGSWMAGAAGTAATYWCCC TCCTTWCACT | 2984 | 3452 |
| VK3-11_1_1_10 | CCTGAAGATTTTGCAGTTTATTACTGTSWMSWMAGAAGTAA TTGGCCTCCTMTCACTTTTGGCGGAGGGACCAAG | SWMSWMAGAAGTAATTGGCC TCCTMTCACT | 2985 | 3453 |
| VK3-11_10_1_10 | CCTGAAGATTTTGCAGTTTATTACTGTCAGCAGBHCNHCAA TTGGCCTCCTMTCACTTTTGGCGGAGGGACCAAG | CAGCAGBHCNHCAATTGGCC TCCTMTCACT | 2986 | 3454 |
| VK3-11_11_1_10 | CCTGAAGATTTTGCAGTTTATTACTGTCAGCAGBHCAGTNH CTGGCCTCCTMTCACTTTTGGCGGAGGGACCAAG | CAGCAGBHCAGTNHCTGGCC TCCTMTCACT | 2987 | 3455 |
| VK3-11_12_1_10 | CCTGAAGATTTTGCAGTTTATTACTGTCAGCAGBHCAGTAA TYWCCCTCCTMTCACTTTTGGCGGAGGGACCAAG | CAGCAGBHCAGTAATYWCCC TCCTMTCACT | 2988 | 3456 |
| VK3-11_13_1_10 | CCTGAAGATTTTGCAGTTTATTACTGTCAGCAGAGANHCNH CTGGCCTCCTMTCACTTTTGGCGGAGGGACCAAG | CAGCAGAGANHCNHCTGGCC TCCTMTCACT | 2989 | 3457 |
| VK3-11_14_1_10 | CCTGAAGATTTTGCAGTTTATTACTGTCAGCAGAGANHCAA TYWCCCTCCTMTCACTTTTGGCGGAGGGACCAAG | CAGCAGAGANHCAATYWCCC TCCTMTCACT | 2990 | 3458 |
| VK3-11_15_1_10 | CCTGAAGATTTTGCAGTTTATTACTGTCAGCAGAGAAGTNH CYWCCCTCCTMTCACTTTTGGCGGAGGGACCAAG | CAGCAGAGAAGTNHCYWCCC TCCTMTCACT | 2991 | 3459 |
| VK3-11_2_1_10 | CCTGAAGATTTTGCAGTTTATTACTGTSWMCAGBHCAGTAA TTGGCCTCCTMTCACTTTTGGCGGAGGGACCAAG | SWMCAGBHCAGTAATTGGCC TCCTMTCACT | 2992 | 3460 |
| VK3-11_3_1_10 | CCTGAAGATTTTGCAGTTTATTACTGTSWMCAGAGANHCAA TTGGCCTCCTMTCACTTTTGGCGGAGGGACCAAG | SWMCAGAGANHCAATTGGCC TCCTMTCACT | 2993 | 3461 |
| VK3-11_4_1_10 | CCTGAAGATTTTGCAGTTTATTACTGTSWMCAGAGAAGTNH CTGGCCTCCTMTCACTTTTGGCGGAGGGACCAAG | SWMCAGAGAAGTNHCTGGCC TCCTMTCACT | 2994 | 3462 |
| VK3-11_5_1_10 | CCTGAAGATTTTGCAGTTTATTACTGTSWMCAGAGAAGTAA TYWCCCTCCTMTCACTTTTGGCGGAGGGACCAAG | SWMCAGAGAAGTAATYWCCC TCCTMTCACT | 2995 | 3463 |
| VK3-11_6_1_10 | CCTGAAGATTTTGCAGTTTATTACTGTCAGSWMBHCAGTAA TTGGCCTCCTMTCACTTTTGGCGGAGGGACCAAG | CAGSWMBHCAGTAATTGGCC TCCTMTCACT | 2996 | 3464 |
| VK3-11_7_1_10 | CCTGAAGATTTTGCAGTTTATTACTGTCAGSWMAGANHCAA TTGGCCTCCTMTCACTTTTGGCGGAGGGACCAAG | CAGSWMAGANHCAATTGGCC TCCTMTCACT | 2997 | 3465 |
| VK3-11_8_1_10 | CCTGAAGATTTTGCAGTTTATTACTGTCAGSWMAGAAGTNH CTGGCCTCCTMTCACTTTTGGCGGAGGGACCAAG | CAGSWMAGAAGTNHCTGGCC TCCTMTCACT | 2998 | 3466 |
| VK3-11_9_1_10 | CCTGAAGATTTTGCAGTTTATTACTGTCAGSWMAGAAGTAA TYWCCCTCCTMTCACTTTTGGCGGAGGGACCAAG | CAGSWMAGAAGTAATYWCCC TCCTMTCACT | 2999 | 3467 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_1_2_10 | CCTGAAGATTTTGCAGTTTATTACTGTSWMSWMAGAAGTAATTGGCCTCCTWGGACTTTTGGCGGAGGGACCAAG | SWMSWMAGAAGTAATTGGCCTCCTWGGACT | 3000 | 3468 |
| VK3-11_10_2_10 | CCTGAAGATTTTGCAGTTTATTACTGTCAGCAGBHCNHCAATTGGCCTCCTWGGACTTTTGGCGGAGGGACCAAG | CAGCAGBHCNHCAATTGGCCTCCTWGGACT | 3001 | 3469 |
| VK3-11_11_2_10 | CCTGAAGATTTTGCAGTTTATTACTGTCAGCAGBHCAGTNHCTGGCCTCCTWGGACTTTTGGCGGAGGGACCAAG | CAGCAGBHCAGTNHCTGGCCTCCTWGGACT | 3002 | 3470 |
| VK3-11_12_2_10 | CCTGAAGATTTTGCAGTTTATTACTGTCAGCAGBHCAGTAATYWCCCTCCTWGGACTTTTGGCGGAGGGACCAAG | CAGCAGBHCAGTAATYWCCCTCCTWGGACT | 3003 | 3471 |
| VK3-11_13_2_10 | CCTGAAGATTTTGCAGTTTATTACTGTCAGCAGAGANHCNHCTGGCCTCCTWGGACTTTTGGCGGAGGGACCAAG | CAGCAGAGANHCNHCTGGCCTCCTWGGACT | 3004 | 3472 |
| VK3-11_14_2_10 | CCTGAAGATTTTGCAGTTTATTACTGTCAGCAGAGANHCAATYWCCCTCCTWGGACTTTTGGCGGAGGGACCAAG | CAGCAGAGANHCAATYWCCCTCCTWGGACT | 3005 | 3473 |
| VK3-11_15_2_10 | CCTGAAGATTTTGCAGTTTATTACTGTCAGCAGAGAAGTNHCYWCCCTCCTWGGACTTTTGGCGGAGGGACCAAG | CAGCAGAGAAGTNHCYWCCCTCCTWGGACT | 3006 | 3474 |
| VK3-11_2_2_10 | CCTGAAGATTTTGCAGTTTATTACTGTSWMCAGBHCAGTAATTGGCCTCCTWGGACTTTTGGCGGAGGGACCAAG | SWMCAGBHCAGTAATTGGCCTCCTWGGACT | 3007 | 3475 |
| VK3-11_3_2_10 | CCTGAAGATTTTGCAGTTTATTACTGTSWMCAGAGANHCAATTGGCCTCCTWGGACTTTTGGCGGAGGGACCAAG | SWMCAGAGANHCAATTGGCCTCCTWGGACT | 3008 | 3476 |
| VK3-11_4_2_10 | CCTGAAGATTTTGCAGTTTATTACTGTSWMCAGAGAAGTNHCTGGCCTCCTWGGACTTTTGGCGGAGGGACCAAG | SWMCAGAGAAGTNHCTGGCCTCCTWGGACT | 3009 | 3477 |
| VK3-11_5_2_10 | CCTGAAGATTTTGCAGTTTATTACTGTSWMCAGAGAAGTAATYWCCCTCCTWGGACTTTTGGCGGAGGGACCAAG | SWMCAGAGAAGTAATYWCCCTCCTWGGACT | 3010 | 3478 |
| VK3-11_6_2_10 | CCTGAAGATTTTGCAGTTTATTACTGTCAGSWMBHCAGTAATTGGCCTCCTWGGACTTTTGGCGGAGGGACCAAG | CAGSWMBHCAGTAATTGGCCTCCTWGGACT | 3011 | 3479 |
| VK3-11_7_2_10 | CCTGAAGATTTTGCAGTTTATTACTGTCAGSWMAGANHCAATTGGCCTCCTWGGACTTTTGGCGGAGGGACCAAG | CAGSWMAGANHCAATTGGCCTCCTWGGACT | 3012 | 3480 |
| VK3-11_8_2_10 | CCTGAAGATTTTGCAGTTTATTACTGTCAGSWMAGAAGTNHCTGGCCTCCTWGGACTTTTGGCGGAGGGACCAAG | CAGSWMAGAAGTNHCTGGCCTCCTWGGACT | 3013 | 3481 |
| VK3-11_9_2_10 | CCTGAAGATTTTGCAGTTTATTACTGTCAGSWMAGAAGTAATYWCCCTCCTWGGACTTTTGGCGGAGGGACCAAG | CAGSWMAGAAGTAATYWCCCTCCTWGGACT | 3014 | 3482 |
| VK3-15_1_0_10 | CAGTCTGAAGATTTTGCAGTTTATTACTGTSWMSWMTACAATAATTGGCCTCCTTWCACTTTTGGCGGAGGGACCAAG | SWMSWMTACAATAATTGGCCTCCTTWCACT | 3015 | 3483 |
| VK3-15_10_0_10 | CAGTCTGAAGATTTTGCAGTTTATTACTGTCAGCAGBHCNHCAATTGGCCTCCTTWCACTTTTGGCGGAGGGACCAAG | CAGCAGBHCNHCAATTGGCCTCCTTWCACT | 3016 | 3439 |
| VK3-15_11_0_10 | CAGTCTGAAGATTTTGCAGTTTATTACTGTCAGCAGBHCAATNHCTGGCCTCCTTWCACTTTTGGCGGAGGGACCAAG | CAGCAGBHCAATNHCTGGCCTCCTTWCACT | 3017 | 3484 |
| VK3-15_12_0_10 | CAGTCTGAAGATTTTGCAGTTTATTACTGTCAGCAGBHCAATAATYWCCCTCCTTWCACTTTTGGCGGAGGGACCAAG | CAGCAGBHCAATAATYWCCCTCCTTWCACT | 3018 | 3485 |
| VK3-15_13_0_10 | CAGTCTGAAGATTTTGCAGTTTATTACTGTCAGCAGTACNHCNHCTGGCCTCCTTWCACTTTTGGCGGAGGGACCAAG | CAGCAGTACNHCNHCTGGCCTCCTTWCACT | 3019 | 3486 |
| VK3-15_14_0_10 | CAGTCTGAAGATTTTGCAGTTTATTACTGTCAGCAGTACNHCAATYWCCCTCCTTWCACTTTTGGCGGAGGGACCAAG | CAGCAGTACNHCAATYWCCCTCCTTWCACT | 3020 | 3308 |
| VK3-15_15_0_10 | CAGTCTGAAGATTTTGCAGTTTATTACTGTCAGCAGTACAATNHCYWCCCTCCTTWCACTTTTGGCGGAGGGACCAAG | CAGCAGTACAATNHCYWCCCTCCTTWCACT | 3021 | 3487 |
| VK3-15_2_0_10 | CAGTCTGAAGATTTTGCAGTTTATTACTGTSWMCAGBHCAATAATTGGCCTCCTTWCACTTTTGGCGGAGGGACCAAG | SWMCAGBHCAATAATTGGCCTCCTTWCACT | 3022 | 3488 |
| VK3-15_3_0_10 | CAGTCTGAAGATTTTGCAGTTTATTACTGTSWMCAGTACNHCAATTGGCCTCCTTWCACTTTTGGCGGAGGGACCAAG | SWMCAGTACNHCAATTGGCCTCCTTWCACT | 3023 | 3489 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-15_4_0_10 | CAGTCTGAAGATTTTGCAGTTTATTACTGTSWMCAGTACAATNHCTGGCCTCCTTWCACTTTTGGCGGAGGGACCAAG | SWMCAGTACAATNHCTGGCCTCCTTWCACT | 3024 | 3490 |
| VK3-15_5_0_10 | CAGTCTGAAGATTTTGCAGTTTATTACTGTSWMCAGTACAATAATYWCCCTCCTTWCACTTTTGGCGGAGGGACCAAG | SWMCAGTACAATAATYWCCCTCCTTWCACT | 3025 | 3491 |
| VK3-15_6_0_10 | CAGTCTGAAGATTTTGCAGTTTATTACTGTCAGSWMBHCAATAATTGGCCTCCTTWCACTTTTGGCGGAGGGACCAAG | CAGSWMBHCAATAATTGGCCTCCTTWCACT | 3026 | 3492 |
| VK3-15_7_0_10 | CAGTCTGAAGATTTTGCAGTTTATTACTGTCAGSWMTACNHCAATTGGCCTCCTTWCACTTTTGGCGGAGGGACCAAG | CAGSWMTACNHCAATTGGCCTCCTTWCACT | 3027 | 3493 |
| VK3-15_8_0_10 | CAGTCTGAAGATTTTGCAGTTTATTACTGTCAGSWMTACAATNHCTGGCCTCCTTWCACTTTTGGCGGAGGGACCAAG | CAGSWMTACAATNHCTGGCCTCCTTWCACT | 3028 | 3494 |
| VK3-15_9_0_10 | CAGTCTGAAGATTTTGCAGTTTATTACTGTCAGSWMTACAATAATYWCCCTCCTTWCACTTTTGGCGGAGGGACCAAG | CAGSWMTACAATAATYWCCCTCCTTWCACT | 3029 | 3495 |
| VK3-15_1_1_10 | CAGTCTGAAGATTTTGCAGTTTATTACTGTSWMSWMTACAATAATTGGCCTCCTMTCACTTTTGGCGGAGGGACCAAG | SWMSWMTACAATAATTGGCCTCCTMTCACT | 3030 | 3496 |
| VK3-15_10_1_10 | CAGTCTGAAGATTTTGCAGTTTATTACTGTCAGCAGBHCNHCAATTGGCCTCCTMTCACTTTTGGCGGAGGGACCAAG | CAGCAGBHCNHCAATTGGCCTCCTMTCACT | 3031 | 3454 |
| VK3-15_11_1_10 | CAGTCTGAAGATTTTGCAGTTTATTACTGTCAGCAGBHCAATNHCTGGCCTCCTMTCACTTTTGGCGGAGGGACCAAG | CAGCAGBHCAATNHCTGGCCTCCTMTCACT | 3032 | 3497 |
| VK3-15_12_1_10 | CAGTCTGAAGATTTTGCAGTTTATTACTGTCAGCAGBHCAATAATYWCCCTCCTMTCACTTTTGGCGGAGGGACCAAG | CAGCAGBHCAATAATYWCCCTCCTMTCACT | 3033 | 3498 |
| VK3-15_13_1_10 | CAGTCTGAAGATTTTGCAGTTTATTACTGTCAGCAGTACNHCNHCTGGCCTCCTMTCACTTTTGGCGGAGGGACCAAG | CAGCAGTACNHCNHCTGGCCTCCTMTCACT | 3034 | 3499 |
| VK3-15_14_1_10 | CAGTCTGAAGATTTTGCAGTTTATTACTGTCAGCAGTACNHCAATYWCCCTCCTMTCACTTTTGGCGGAGGGACCAAG | CAGCAGTACNHCAATYWCCCTCCTMTCACT | 3035 | 3323 |
| VK3-15_15_1_10 | CAGTCTGAAGATTTTGCAGTTTATTACTGTCAGCAGTACAATNHCYWCCCTCCTMTCACTTTTGGCGGAGGGACCAAG | CAGCAGTACAATNHCYWCCCTCCTMTCACT | 3036 | 3500 |
| VK3-15_2_1_10 | CAGTCTGAAGATTTTGCAGTTTATTACTGTSWMCAGBHCAATAATTGGCCTCCTMTCACTTTTGGCGGAGGGACCAAG | SWMCAGBHCAATAATTGGCCTCCTMTCACT | 3037 | 3501 |
| VK3-15_3_1_10 | CAGTCTGAAGATTTTGCAGTTTATTACTGTSWMCAGTACNHCAATTGGCCTCCTMTCACTTTTGGCGGAGGGACCAAG | SWMCAGTACNHCAATTGGCCTCCTMTCACT | 3038 | 3502 |
| VK3-15_4_1_10 | CAGTCTGAAGATTTTGCAGTTTATTACTGTSWMCAGTACAATNHCTGGCCTCCTMTCACTTTTGGCGGAGGGACCAAG | SWMCAGTACAATNHCTGGCCTCCTMTCACT | 3039 | 3503 |
| VK3-15_5_1_10 | CAGTCTGAAGATTTTGCAGTTTATTACTGTSWMCAGTACAATAATYWCCCTCCTMTCACTTTTGGCGGAGGGACCAAG | SWMCAGTACAATAATYWCCCTCCTMTCACT | 3040 | 3504 |
| VK3-15_6_1_10 | CAGTCTGAAGATTTTGCAGTTTATTACTGTCAGSWMBHCAATAATTGGCCTCCTMTCACTTTTGGCGGAGGGACCAAG | CAGSWMBHCAATAATTGGCCTCCTMTCACT | 3041 | 3505 |
| VK3-15_7_1_10 | CAGTCTGAAGATTTTGCAGTTTATTACTGTCAGSWMTACNHCAATTGGCCTCCTMTCACTTTTGGCGGAGGGACCAAG | CAGSWMTACNHCAATTGGCCTCCTMTCACT | 3042 | 3506 |
| VK3-15_8_1_10 | CAGTCTGAAGATTTTGCAGTTTATTACTGTCAGSWMTACAATNHCTGGCCTCCTMTCACTTTTGGCGGAGGGACCAAG | CAGSWMTACAATNHCTGGCCTCCTMTCACT | 3043 | 3507 |
| VK3-15_9_1_10 | CAGTCTGAAGATTTTGCAGTTTATTACTGTCAGSWMTACAATAATYWCCCTCCTMTCACTTTTGGCGGAGGGACCAAG | CAGSWMTACAATAATYWCCCTCCTMTCACT | 3044 | 3508 |
| VK3-15_1_2_10 | CAGTCTGAAGATTTTGCAGTTTATTACTGTSWMSWMTACAATAATTGGCCTCCTWGGACTTTTGGCGGAGGGACCAAG | SWMSWMTACAATAATTGGCCTCCTWGGACT | 3045 | 3509 |
| VK3-15_10_2_10 | CAGTCTGAAGATTTTGCAGTTTATTACTGTCAGCAGBHCNHCAATTGGCCTCCTWGGACTTTTGGCGGAGGGACCAAG | CAGCAGBHCNHCAATTGGCCTCCTWGGACT | 3046 | 3469 |
| VK3-15_11_2_10 | CAGTCTGAAGATTTTGCAGTTTATTACTGTCAGCAGBHCAATNHCTGGCCTCCTWGGACTTTTGGCGGAGGGACCAAG | CAGCAGBHCAATNHCTGGCCTCCTWGGACT | 3047 | 3510 |
| VK3-15_12_2_10 | CAGTCTGAAGATTTTGCAGTTTATTACTGTCAGCAGBHCAATAATYWCCCTCCTWGGACTTTTGGCGGAGGGACCAAG | CAGCAGBHCAATAATYWCCCTCCTWGGACT | 3048 | 3511 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-15_13_2_10 | CAGTCTGAAGATTTTGCAGTTTATTACTGTCAGCAGTACNHCNHCTGGCCTCCTWGGACTTTTGGCGGAGGGACCAAG | CAGCAGTACNHCNHCTGGCCTCCTWGGACT | 3049 | 3512 |
| VK3-15_14_2_10 | CAGTCTGAAGATTTTGCAGTTTATTACTGTCAGCAGTACNHCAATYWCCCTCCTWGGACTTTTGGCGGAGGGACCAAG | CAGCAGTACNHCAATYWCCCTCCTWGGACT | 3050 | 3338 |
| VK3-15_15_2_10 | CAGTCTGAAGATTTTGCAGTTTATTACTGTCAGCAGTACAATNHCYWCCCTCCTWGGACTTTTGGCGGAGGGACCAAG | CAGCAGTACAATNHCYWCCCTCCTWGGACT | 3051 | 3513 |
| VK3-15_2_2_10 | CAGTCTGAAGATTTTGCAGTTTATTACTGTSWMCAGBHCAATAATTGGCCTCCTWGGACTTTTGGCGGAGGGACCAAG | SWMCAGBHCAATAATTGGCCTCCTWGGACT | 3052 | 3514 |
| VK3-15_3_2_10 | CAGTCTGAAGATTTTGCAGTTTATTACTGTSWMCAGTACNHCAATTGGCCTCCTWGGACTTTTGGCGGAGGGACCAAG | SWMCAGTACNHCAATTGGCCTCCTWGGACT | 3053 | 3515 |
| VK3-15_4_2_10 | CAGTCTGAAGATTTTGCAGTTTATTACTGTSWMCAGTACAATNHCTGGCCTCCTWGGACTTTTGGCGGAGGGACCAAG | SWMCAGTACAATNHCTGGCCTCCTWGGACT | 3054 | 3516 |
| VK3-15_5_2_10 | CAGTCTGAAGATTTTGCAGTTTATTACTGTSWMCAGTACAATAATYWCCCTCCTWGGACTTTTGGCGGAGGGACCAAG | SWMCAGTACAATAATYWCCCTCCTWGGACT | 3055 | 3517 |
| VK3-15_6_2_10 | CAGTCTGAAGATTTTGCAGTTTATTACTGTCAGSWMBHCAATAATTGGCCTCCTWGGACTTTTGGCGGAGGGACCAAG | CAGSWMBHCAATAATTGGCCTCCTWGGACT | 3056 | 3518 |
| VK3-15_7_2_10 | CAGTCTGAAGATTTTGCAGTTTATTACTGTCAGSWMTACNHCAATTGGCCTCCTWGGACTTTTGGCGGAGGGACCAAG | CAGSWMTACNHCAATTGGCCTCCTWGGACT | 3057 | 3519 |
| VK3-15_8_2_10 | CAGTCTGAAGATTTTGCAGTTTATTACTGTCAGSWMTACAATNHCTGGCCTCCTWGGACTTTTGGCGGAGGGACCAAG | CAGSWMTACAATNHCTGGCCTCCTWGGACT | 3058 | 3520 |
| VK3-15_9_2_10 | CAGTCTGAAGATTTTGCAGTTTATTACTGTCAGSWMTACAATAATYWCCCTCCTWGGACTTTTGGCGGAGGGACCAAG | CAGSWMTACAATAATYWCCCTCCTWGGACT | 3059 | 3521 |
| VK3-20_1_0_10 | CCTGAAGATTTTGCAGTGTATTACTGTSWMSWMTACGGAAGTAGTCCTCCTTWCACTTTTGGCGGAGGGACCAAG | SWMSWMTACGGAAGTAGTCCTCCTTWCACT | 3060 | 3522 |
| VK3-20_10_0_10 | CCTGAAGATTTTGCAGTGTATTACTGTCAGCAGBHCBHCAGTAGTCCTCCTTWCACTTTTGGCGGAGGGACCAAG | CAGCAGBHCBHCAGTAGTCCTCCTTWCACT | 3061 | 3523 |
| VK3-20_11_0_10 | CCTGAAGATTTTGCAGTGTATTACTGTCAGCAGBHCGGAVNCAGTCCTCCTTWCACTTTTGGCGGAGGGACCAAG | CAGCAGBHCGGAVNCAGTCCTCCTTWCACT | 3062 | 3524 |
| VK3-20_12_0_10 | CCTGAAGATTTTGCAGTGTATTACTGTCAGCAGBHCGGAAGTBHCCCTCCTTWCACTTTTGGCGGAGGGACCAAG | CAGCAGBHCGGAAGTBHCCCTCCTTWCACT | 3063 | 3525 |
| VK3-20_13_0_10 | CCTGAAGATTTTGCAGTGTATTACTGTCAGCAGTACBHCVNCAGTCCTCCTTWCACTTTTGGCGGAGGGACCAAG | CAGCAGTACBHCVNCAGTCCTCCTTWCACT | 3064 | 3526 |
| VK3-20_14_0_10 | CCTGAAGATTTTGCAGTGTATTACTGTCAGCAGTACBHCAGTBHCCCTCCTTWCACTTTTGGCGGAGGGACCAAG | CAGCAGTACBHCAGTBHCCCTCCTTWCACT | 3065 | 3527 |
| VK3-20_15_0_10 | CCTGAAGATTTTGCAGTGTATTACTGTCAGCAGTACGGAVNCBHCCCTCCTTWCACTTTTGGCGGAGGGACCAAG | CAGCAGTACGGAVNCBHCCCTCCTTWCACT | 3066 | 3528 |
| VK3-20_2_0_10 | CCTGAAGATTTTGCAGTGTATTACTGTSWMCAGBHCGGAAGTAGTCCTCCTTWCACTTTTGGCGGAGGGACCAAG | SWMCAGBHCGGAAGTAGTCCTCCTTWCACT | 3067 | 3529 |
| VK3-20_3_0_10 | CCTGAAGATTTTGCAGTGTATTACTGTSWMCAGTACBHCAGTAGTCCTCCTTWCACTTTTGGCGGAGGGACCAAG | SWMCAGTACBHCAGTAGTCCTCCTTWCACT | 3068 | 3530 |
| VK3-20_4_0_10 | CCTGAAGATTTTGCAGTGTATTACTGTSWMCAGTACGGAVNCAGTCCTCCTTWCACTTTTGGCGGAGGGACCAAG | SWMCAGTACGGAVNCAGTCCTCCTTWCACT | 3069 | 3531 |
| VK3-20_5_0_10 | CCTGAAGATTTTGCAGTGTATTACTGTSWMCAGTACGGAAGTBHCCCTCCTTWCACTTTTGGCGGAGGGACCAAG | SWMCAGTACGGAAGTBHCCCTCCTTWCACT | 3070 | 3532 |
| VK3-20_6_0_10 | CCTGAAGATTTTGCAGTGTATTACTGTCAGSWMBHCGGAAGTAGTCCTCCTTWCACTTTTGGCGGAGGGACCAAG | CAGSWMBHCGGAAGTAGTCCTCCTTWCACT | 3071 | 3533 |
| VK3-20_7_0_10 | CCTGAAGATTTTGCAGTGTATTACTGTCAGSWMTACBHCAGTAGTCCTCCTTWCACTTTTGGCGGAGGGACCAAG | CAGSWMTACBHCAGTAGTCCTCCTTWCACT | 3072 | 3534 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_8_0_10 | CCTGAAGATTTTGCAGTGTATTACTGTCAGSWMTACGGAVNCAGTCCTCCTTWCACTTTTGGCGGAGGGACCAAG | CAGSWMTACGGAVNCAGTCCTCCTTWCACT | 3073 | 3535 |
| VK3-20_9_0_10 | CCTGAAGATTTTGCAGTGTATTACTGTCAGSWMTACGGAAGTBHCCCTCCTTWCACTTTTGGCGGAGGGACCAAG | CAGSWMTACGGAAGTBHCCCTCCTTWCACT | 3074 | 3536 |
| VK3-20_1_1_10 | CCTGAAGATTTTGCAGTGTATTACTGTSWMSWMTACGGAAGTAGTCCTCCTMTCACTTTTGGCGGAGGGACCAAG | SWMSWMTACGGAAGTAGTCCTCCTMTCACT | 3075 | 3537 |
| VK3-20_10_1_10 | CCTGAAGATTTTGCAGTGTATTACTGTCAGCAGBHCBHCAGTAGTCCTCCTMTCACTTTTGGCGGAGGGACCAAG | CAGCAGBHCBHCAGTAGTCCTCCTMTCACT | 3076 | 3538 |
| VK3-20_11_1_10 | CCTGAAGATTTTGCAGTGTATTACTGTCAGCAGBHCGGAVNCAGTCCTCCTMTCACTTTTGGCGGAGGGACCAAG | CAGCAGBHCGGAVNCAGTCCTCCTMTCACT | 3077 | 3539 |
| VK3-20_12_1_10 | CCTGAAGATTTTGCAGTGTATTACTGTCAGCAGBHCGGAAGTBHCCCTCCTMTCACTTTTGGCGGAGGGACCAAG | CAGCAGBHCGGAAGTBHCCCTCCTMTCACT | 3078 | 3540 |
| VK3-20_13_1_10 | CCTGAAGATTTTGCAGTGTATTACTGTCAGCAGTACBHCVNCAGTCCTCCTMTCACTTTTGGCGGAGGGACCAAG | CAGCAGTACBHCVNCAGTCCTCCTMTCACT | 3079 | 3541 |
| VK3-20_14_1_10 | CCTGAAGATTTTGCAGTGTATTACTGTCAGCAGTACBHCAGTBHCCCTCCTMTCACTTTTGGCGGAGGGACCAAG | CAGCAGTACBHCAGTBHCCCTCCTMTCACT | 3080 | 3542 |
| VK3-20_15_1_10 | CCTGAAGATTTTGCAGTGTATTACTGTCAGCAGTACGGAVNCBHCCCTCCTMTCACTTTTGGCGGAGGGACCAAG | CAGCAGTACGGAVNCBHCCCTCCTMTCACT | 3081 | 3543 |
| VK3-20_2_1_10 | CCTGAAGATTTTGCAGTGTATTACTGTSWMCAGBHCGGAAGTAGTCCTCCTMTCACTTTTGGCGGAGGGACCAAG | SWMCAGBHCGGAAGTAGTCCTCCTMTCACT | 3082 | 3544 |
| VK3-20_3_1_10 | CCTGAAGATTTTGCAGTGTATTACTGTSWMCAGTACBHCAGTAGTCCTCCTMTCACTTTTGGCGGAGGGACCAAG | SWMCAGTACBHCAGTAGTCCTCCTMTCACT | 3083 | 3545 |
| VK3-20_4_1_10 | CCTGAAGATTTTGCAGTGTATTACTGTSWMCAGTACGGAVNCAGTCCTCCTMTCACTTTTGGCGGAGGGACCAAG | SWMCAGTACGGAVNCAGTCCTCCTMTCACT | 3084 | 3546 |
| VK3-20_5_1_10 | CCTGAAGATTTTGCAGTGTATTACTGTSWMCAGTACGGAAGTBHCCCTCCTMTCACTTTTGGCGGAGGGACCAAG | SWMCAGTACGGAAGTBHCCCTCCTMTCACT | 3085 | 3547 |
| VK3-20_6_1_10 | CCTGAAGATTTTGCAGTGTATTACTGTCAGSWMBHCGGAAGTAGTCCTCCTMTCACTTTTGGCGGAGGGACCAAG | CAGSWMBHCGGAAGTAGTCCTCCTMTCACT | 3086 | 3548 |
| VK3-20_7_1_10 | CCTGAAGATTTTGCAGTGTATTACTGTCAGSWMTACBHCAGTAGTCCTCCTMTCACTTTTGGCGGAGGGACCAAG | CAGSWMTACBHCAGTAGTCCTCCTMTCACT | 3087 | 3549 |
| VK3-20_8_1_10 | CCTGAAGATTTTGCAGTGTATTACTGTCAGSWMTACGGAVNCAGTCCTCCTMTCACTTTTGGCGGAGGGACCAAG | CAGSWMTACGGAVNCAGTCCTCCTMTCACT | 3088 | 3550 |
| VK3-20_9_1_10 | CCTGAAGATTTTGCAGTGTATTACTGTCAGSWMTACGGAAGTBHCCCTCCTMTCACTTTTGGCGGAGGGACCAAG | CAGSWMTACGGAAGTBHCCCTCCTMTCACT | 3089 | 3551 |
| VK3-20_1_2_10 | CCTGAAGATTTTGCAGTGTATTACTGTSWMSWMTACGGAAGTAGTCCTCCTWGGACTTTTGGCGGAGGGACCAAG | SWMSWMTACGGAAGTAGTCCTCCTWGGACT | 3090 | 3552 |
| VK3-20_10_2_10 | CCTGAAGATTTTGCAGTGTATTACTGTCAGCAGBHCBHCAGTAGTCCTCCTWGGACTTTTGGCGGAGGGACCAAG | CAGCAGBHCBHCAGTAGTCCTCCTWGGACT | 3091 | 3553 |
| VK3-20_11_2_10 | CCTGAAGATTTTGCAGTGTATTACTGTCAGCAGBHCGGAVNCAGTCCTCCTWGGACTTTTGGCGGAGGGACCAAG | CAGCAGBHCGGAVNCAGTCCTCCTWGGACT | 3092 | 3554 |
| VK3-20_12_2_10 | CCTGAAGATTTTGCAGTGTATTACTGTCAGCAGBHCGGAAGTBHCCCTCCTWGGACTTTTGGCGGAGGGACCAAG | CAGCAGBHCGGAAGTBHCCCTCCTWGGACT | 3093 | 3555 |
| VK3-20_13_2_10 | CCTGAAGATTTTGCAGTGTATTACTGTCAGCAGTACBHCVNCAGTCCTCCTWGGACTTTTGGCGGAGGGACCAAG | CAGCAGTACBHCVNCAGTCCTCCTWGGACT | 3094 | 3556 |
| VK3-20_14_2_10 | CCTGAAGATTTTGCAGTGTATTACTGTCAGCAGTACBHCAGTBHCCCTCCTWGGACTTTTGGCGGAGGGACCAAG | CAGCAGTACBHCAGTBHCCCTCCTWGGACT | 3095 | 3557 |
| VK3-20_15_2_10 | CCTGAAGATTTTGCAGTGTATTACTGTCAGCAGTACGGAVNCBHCCCTCCTWGGACTTTTGGCGGAGGGACCAAG | CAGCAGTACGGAVNCBHCCCTCCTWGGACT | 3096 | 3558 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-20_2_2_10 | CCTGAAGATTTTGCAGTGTATTACTGTSWMCAGBHCGGAAGTAGTCCTCCTWGGACTTTTGGCGGAGGGACCAAG | SWMCAGBHCGGAAGTAGTCCTCCTWGGACT | 3097 | 3559 |
| VK3-20_3_2_10 | CCTGAAGATTTTGCAGTGTATTACTGTSWMCAGTACBHCAGTAGTCCTCCTWGGACTTTTGGCGGAGGGACCAAG | SWMCAGTACBHCAGTAGTCCTCCTWGGACT | 3098 | 3560 |
| VK3-20_4_2_10 | CCTGAAGATTTTGCAGTGTATTACTGTSWMCAGTACGGAVNCAGTCCTCCTWGGACTTTTGGCGGAGGGACCAAG | SWMCAGTACGGAVNCAGTCCTCCTWGGACT | 3099 | 3561 |
| VK3-20_5_2_10 | CCTGAAGATTTTGCAGTGTATTACTGTSWMCAGTACGGAAGTBHCCCTCCTWGGACTTTTGGCGGAGGGACCAAG | SWMCAGTACGGAAGTBHCCCTCCTWGGACT | 3100 | 3562 |
| VK3-20_6_2_10 | CCTGAAGATTTTGCAGTGTATTACTGTCAGSWMBHCGGAAGTAGTCCTCCTWGGACTTTTGGCGGAGGGACCAAG | CAGSWMBHCGGAAGTAGTCCTCCTWGGACT | 3101 | 3563 |
| VK3-20_7_2_10 | CCTGAAGATTTTGCAGTGTATTACTGTCAGSWMTACBHCAGTAGTCCTCCTWGGACTTTTGGCGGAGGGACCAAG | CAGSWMTACBHCAGTAGTCCTCCTWGGACT | 3102 | 3564 |
| VK3-20_8_2_10 | CCTGAAGATTTTGCAGTGTATTACTGTCAGSWMTACGGAVNCAGTCCTCCTWGGACTTTTGGCGGAGGGACCAAG | CAGSWMTACGGAVNCAGTCCTCCTWGGACT | 3103 | 3565 |
| VK3-20_9_2_10 | CCTGAAGATTTTGCAGTGTATTACTGTCAGSWMTACGGAAGTBHCCCTCCTWGGACTTTTGGCGGAGGGACCAAG | CAGSWMTACGGAAGTBHCCCTCCTWGGACT | 3104 | 3566 |
| Jumping Trimer | | | | |
| VK1-05_t1_0_10 | CCTGATGATTTTGCAACTTATTACTGCCAGCAGBHCVRMMBCTACYCTCCTTWCACTTTTGGCGGAGGGACCAAG | CAGCAGBHCVRMMBCTACYCTCCTTWCACT | 3105 | 3567 |
| VK1-05_t1_1_10 | CCTGATGATTTTGCAACTTATTACTGCCAGCAGBHCVRMMBCTACYCTCCTMTCACTTTTGGCGGAGGGACCAAG | CAGCAGBHCVRMMBCTACYCTCCTMTCACT | 3106 | 3568 |
| VK1-05_t1_2_10 | CCTGATGATTTTGCAACTTATTACTGCCAGCAGBHCVRMMBCTACYCTCCTWGGACTTTTGGCGGAGGGACCAAG | CAGCAGBHCVRMMBCTACYCTCCTWGGACT | 3107 | 3569 |
| VK1-05_t2_0_10 | CCTGATGATTTTGCAACTTATTACTGCCAGCAGBHCAATMBCYWCYCTCCTTWCACTTTTGGCGGAGGGACCAAG | CAGCAGBHCAATMBCYWCYCTCCTTWCACT | 3108 | 3570 |
| VK1-05_t2_1_10 | CCTGATGATTTTGCAACTTATTACTGCCAGCAGBHCAATMBCYWCYCTCCTMTCACTTTTGGCGGAGGGACCAAG | CAGCAGBHCAATMBCYWCYCTCCTMTCACT | 3109 | 3571 |
| VK1-05_t2_2_10 | CCTGATGATTTTGCAACTTATTACTGCCAGCAGBHCAATMBCYWCYCTCCTWGGACTTTTGGCGGAGGGACCAAG | CAGCAGBHCAATMBCYWCYCTCCTWGGACT | 3110 | 3572 |
| VK1-05_t3_0_10 | CCTGATGATTTTGCAACTTATTACTGCCAGCAGBHCVRMAGTYWCYCTCCTTWCACTTTTGGCGGAGGGACCAAG | CAGCAGBHCVRMAGTYWCYCTCCTTWCACT | 3111 | 3573 |
| VK1-05_t3_1_10 | CCTGATGATTTTGCAACTTATTACTGCCAGCAGBHCVRMAGTYWCYCTCCTMTCACTTTTGGCGGAGGGACCAAG | CAGCAGBHCVRMAGTYWCYCTCCTMTCACT | 3112 | 3574 |
| VK1-05_t3_2_10 | CCTGATGATTTTGCAACTTATTACTGCCAGCAGBHCVRMAGTYWCYCTCCTWGGACTTTTGGCGGAGGGACCAAG | CAGCAGBHCVRMAGTYWCYCTCCTWGGACT | 3113 | 3575 |
| VK1-05_t4_0_10 | CCTGATGATTTTGCAACTTATTACTGCCAGCAGTACVRMMBCYWCYCTCCTTWCACTTTTGGCGGAGGGACCAAG | CAGCAGTACVRMMBCYWCYCTCCTTWCACT | 3114 | 3576 |
| VK1-05_t4_1_10 | CCTGATGATTTTGCAACTTATTACTGCCAGCAGTACVRMMBCYWCYCTCCTMTCACTTTTGGCGGAGGGACCAAG | CAGCAGTACVRMMBCYWCYCTCCTMTCACT | 3115 | 3577 |
| VK1-05_t4_2_10 | CCTGATGATTTTGCAACTTATTACTGCCAGCAGTACVRMMBCYWCYCTCCTWGGACTTTTGGCGGAGGGACCAAG | CAGCAGTACVRMMBCYWCYCTCCTWGGACT | 3116 | 3578 |
| VK1-12_t1_0_10 | CCTGAAGATTTTGCAACTTATTACTGTCAGCAGRNANHCNHCTTCCCTCCTTWCACTTTTGGCGGAGGGACCAAG | CAGCAGRNANHCNHCTTCCCTCCTTWCACT | 3117 | 3579 |
| VK1-12_t1_1_10 | CCTGAAGATTTTGCAACTTATTACTGTCAGCAGRNANHCNHCTTCCCTCCTMTCACTTTTGGCGGAGGGACCAAG | CAGCAGRNANHCNHCTTCCCTCCTMTCACT | 3118 | 3580 |
| VK1-12_t1_2_10 | CCTGAAGATTTTGCAACTTATTACTGTCAGCAGRNANHCNHCTTCCCTCCTWGGACTTTTGGCGGAGGGACCAAG | CAGCAGRNANHCNHCTTCCCTCCTWGGACT | 3119 | 3581 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-12_t2_0_10 | CCTGAAGATTTTGCAACTTATTACTGTCAGCAGRNANHCAGTYWCC CTCCTTWCACTTTTGGCGGAGGGACCAAG | CAGCAGRNANHCAGTYWCCCTCC TTWCACT | 3120 | 3582 |
| VK1-12_t2_1_10 | CCTGAAGATTTTGCAACTTATTACTGTCAGCAGRNANHCAGTYWCC CTCCTMTCACTTTTGGCGGAGGGACCAAG | CAGCAGRNANHCAGTYWCCCTCC TMTCACT | 3121 | 3583 |
| VK1-12_t2_2_10 | CCTGAAGATTTTGCAACTTATTACTGTCAGCAGRNANHCAGTYWCC CTCCTWGGACTTTTGGCGGAGGGACCAAG | CAGCAGRNANHCAGTYWCCCTCC TWGGACT | 3122 | 3584 |
| VK1-12_t3_0_10 | CCTGAAGATTTTGCAACTTATTACTGTCAGCAGRNAAATNHCYWCC CTCCTTWCACTTTTGGCGGAGGGACCAAG | CAGCAGRNAAATNHCYWCCCTCC TTWCACT | 3123 | 3585 |
| VK1-12_t3_1_10 | CCTGAAGATTTTGCAACTTATTACTGTCAGCAGRNAAATNHCYWCC CTCCTMTCACTTTTGGCGGAGGGACCAAG | CAGCAGRNAAATNHCYWCCCTCC TMTCACT | 3124 | 3586 |
| VK1-12_t3_2_10 | CCTGAAGATTTTGCAACTTATTACTGTCAGCAGRNAAATNHCYWCC CTCCTWGGACTTTTGGCGGAGGGACCAAG | CAGCAGRNAAATNHCYWCCCTCC TWGGACT | 3125 | 3587 |
| VK1-12_t4_0_10 | CCTGAAGATTTTGCAACTTATTACTGTCAGCAGGCANHCNHCYWCC CTCCTTWCACTTTTGGCGGAGGGACCAAG | CAGCAGGCANHCNHCYWCCCTCC TTWCACT | 3126 | 3588 |
| VK1-12_t4_1_10 | CCTGAAGATTTTGCAACTTATTACTGTCAGCAGGCANHCNHCYWCC CTCCTMTCACTTTTGGCGGAGGGACCAAG | CAGCAGGCANHCNHCYWCCCTCC TMTCACT | 3127 | 3589 |
| VK1-12_t4_2_10 | CCTGAAGATTTTGCAACTTATTACTGTCAGCAGGCANHCNHCYWCC CTCCTWGGACTTTTGGCGGAGGGACCAAG | CAGCAGGCANHCNHCYWCCCTCC TWGGACT | 3128 | 3590 |
| VK1-33_t1_0_10 | CCTGAAGATATTGCAACATATTACTGTCAGCAGBHCNHCNHCCTCC CTCCTTWCACTTTTGGCGGAGGGACCAAG | CAGCAGBHCNHCNHCCTCCCTCC TTWCACT | 3129 | 3591 |
| VK1-33_t1_1_10 | CCTGAAGATATTGCAACATATTACTGTCAGCAGBHCNHCNHCCTCC CTCCTMTCACTTTTGGCGGAGGGACCAAG | CAGCAGBHCNHCNHCCTCCCTCC TMTCACT | 3130 | 3592 |
| VK1-33_t1_2_10 | CCTGAAGATATTGCAACATATTACTGTCAGCAGBHCNHCNHCCTCC CTCCTWGGACTTTTGGCGGAGGGACCAAG | CAGCAGBHCNHCNHCCTCCCTCC TWGGACT | 3131 | 3593 |
| VK1-33_t2_0_10 | CCTGAAGATATTGCAACATATTACTGTCAGCAGBHCNHCAATYWCC CTCCTTWCACTTTTGGCGGAGGGACCAAG | CAGCAGBHCNHCAATYWCCCTCC TTWCACT | 3132 | 3594 |
| VK1-33_t2_1_10 | CCTGAAGATATTGCAACATATTACTGTCAGCAGBHCNHCAATYWCC CTCCTMTCACTTTTGGCGGAGGGACCAAG | CAGCAGBHCNHCAATYWCCCTCC TMTCACT | 3133 | 3595 |
| VK1-33_t2_2_10 | CCTGAAGATATTGCAACATATTACTGTCAGCAGBHCNHCAATYWCC CTCCTWGGACTTTTGGCGGAGGGACCAAG | CAGCAGBHCNHCAATYWCCCTCC TWGGACT | 3134 | 3596 |
| VK1-33_t3_0_10 | CCTGAAGATATTGCAACATATTACTGTCAGCAGBHCGATNHCYWCC CTCCTTWCACTTTTGGCGGAGGGACCAAG | CAGCAGBHCGATNHCYWCCCTCC TTWCACT | 3135 | 3597 |
| VK1-33_t3_1_10 | CCTGAAGATATTGCAACATATTACTGTCAGCAGBHCGATNHCYWCC CTCCTMTCACTTTTGGCGGAGGGACCAAG | CAGCAGBHCGATNHCYWCCCTCC TMTCACT | 3136 | 3598 |
| VK1-33_t3_2_10 | CCTGAAGATATTGCAACATATTACTGTCAGCAGBHCGATNHCYWCC CTCCTWGGACTTTTGGCGGAGGGACCAAG | CAGCAGBHCGATNHCYWCCCTCC TWGGACT | 3137 | 3599 |
| VK1-33_t4_0_10 | CCTGAAGATATTGCAACATATTACTGTCAGCAGTACNHCNHCYWCC CTCCTTWCACTTTTGGCGGAGGGACCAAG | CAGCAGTACNHCNHCYWCCCTCC TTWCACT | 3138 | 3600 |
| VK1-33_t4_1_10 | CCTGAAGATATTGCAACATATTACTGTCAGCAGTACNHCNHCYWCC CTCCTMTCACTTTTGGCGGAGGGACCAAG | CAGCAGTACNHCNHCYWCCCTCC TMTCACT | 3139 | 3601 |
| VK1-33_t4_2_10 | CCTGAAGATATTGCAACATATTACTGTCAGCAGTACNHCNHCYWCC CTCCTWGGACTTTTGGCGGAGGGACCAAG | CAGCAGTACNHCNHCYWCCCTCC TWGGACT | 3140 | 3602 |
| VK1-39_t1_0_10 | CCTGAAGATTTTGCAACTTACTACTGTCAGCAAVNABHCNHCACTC CTCCTTWCACTTTTGGCGGAGGGACCAAG | CAGCAAVNABHCNHCACTCCTCC TTWCACT | 3141 | 3603 |
| VK1-39_t1_1_10 | CCTGAAGATTTTGCAACTTACTACTGTCAGCAAVNABHCNHCACTC CTCCTMTCACTTTTGGCGGAGGGACCAAG | CAGCAAVNABHCNHCACTCCTCC TMTCACT | 3142 | 3604 |
| VK1-39_t1_2_10 | CCTGAAGATTTTGCAACTTACTACTGTCAGCAAVNABHCNHCACTC CTCCTWGGACTTTTGGCGGAGGGACCAAG | CAGCAAVNABHCNHCACTCCTCC TWGGACT | 3143 | 3605 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK1-39_t2_0_10 | CCTGAAGATTTTGCAACTTACTACTGTCAGCAAVNABHCAGTBHCC CTCCTTWCACTTTTGGCGGAGGGACCAAG | CAGCAAVNABHCAGTBHCCCTCC TTWCACT | 3144 | 3606 |
| VK1-39_t2_1_10 | CCTGAAGATTTTGCAACTTACTACTGTCAGCAAVNABHCAGTBHCC CTCCTMTCACTTTTGGCGGAGGGACCAAG | CAGCAAVNABHCAGTBHCCCTCC TMTCACT | 3145 | 3607 |
| VK1-39_t2_2_10 | CCTGAAGATTTTGCAACTTACTACTGTCAGCAAVNABHCAGTBHCC CTCCTWGGACTTTTGGCGGAGGGACCAAG | CAGCAAVNABHCAGTBHCCCTCC TWGGACT | 3146 | 3608 |
| VK1-39_t3_0_10 | CCTGAAGATTTTGCAACTTACTACTGTCAGCAAVNATACNHCBHCC CTCCTTWCACTTTTGGCGGAGGGACCAAG | CAGCAAVNATACNHCBHCCCTCC TTWCACT | 3147 | 3609 |
| VK1-39_t3_1_10 | CCTGAAGATTTTGCAACTTACTACTGTCAGCAAVNATACNHCBHCC CTCCTMTCACTTTTGGCGGAGGGACCAAG | CAGCAAVNATACNHCBHCCCTCC TMTCACT | 3148 | 3610 |
| VK1-39_t3_2_10 | CCTGAAGATTTTGCAACTTACTACTGTCAGCAAVNATACNHCBHCC CTCCTWGGACTTTTGGCGGAGGGACCAAG | CAGCAAVNATACNHCBHCCCTCC TWGGACT | 3149 | 3611 |
| VK1-39_t4_0_10 | CCTGAAGATTTTGCAACTTACTACTGTCAGCAAAGCBHCNHCBHCC CTCCTTWCACTTTTGGCGGAGGGACCAAG | CAGCAAAGCBHCNHCBHCCCTCC TTWCACT | 3150 | 3612 |
| VK1-39_t4_1_10 | CCTGAAGATTTTGCAACTTACTACTGTCAGCAAAGCBHCNHCBHCC CTCCTMTCACTTTTGGCGGAGGGACCAAG | CAGCAAAGCBHCNHCBHCCCTCC TMTCACT | 3151 | 3613 |
| VK1-39_t4_2_10 | CCTGAAGATTTTGCAACTTACTACTGTCAGCAAAGCBHCNHCBHCC CTCCTWGGACTTTTGGCGGAGGGACCAAG | CAGCAAAGCBHCNHCBHCCCTCC TWGGACT | 3152 | 3614 |
| VK2-28_t1_0_10 | GCTGAGGATGTTGGGGTTTATTACTGCATGCAGVNAMNASRMACTC CTCCTTWCACTTTTGGCGGAGGGACCAAG | ATGCAGVNAMNASRMACTCCTCC TTWCACT | 3153 | 3615 |
| VK2-28_t1_1_10 | GCTGAGGATGTTGGGGTTTATTACTGCATGCAGVNAMNASRMACTC CTCCTMTCACTTTTGGCGGAGGGACCAAG | ATGCAGVNAMNASRMACTCCTCC TMTCACT | 3154 | 3616 |
| VK2-28_t1_2_10 | GCTGAGGATGTTGGGGTTTATTACTGCATGCAGVNAMNASRMACTC CTCCTWGGACTTTTGGCGGAGGGACCAAG | ATGCAGVNAMNASRMACTCCTCC TWGGACT | 3155 | 3617 |
| VK2-28_t2_0_10 | GCTGAGGATGTTGGGGTTTATTACTGCATGCAGVNAMNACAGVBCC CTCCTTWCACTTTTGGCGGAGGGACCAAG | ATGCAGVNAMNACAGVBCCCTCC TTWCACT | 3156 | 3618 |
| VK2-28_t2_1_10 | GCTGAGGATGTTGGGGTTTATTACTGCATGCAGVNAMNACAGVBCC CTCCTMTCACTTTTGGCGGAGGGACCAAG | ATGCAGVNAMNACAGVBCCCTCC TMTCACT | 3157 | 3619 |
| VK2-28_t2_2_10 | GCTGAGGATGTTGGGGTTTATTACTGCATGCAGVNAMNACAGVBCC CTCCTWGGACTTTTGGCGGAGGGACCAAG | ATGCAGVNAMNACAGVBCCCTCC TWGGACT | 3158 | 3620 |
| VK2-28_t3_0_10 | GCTGAGGATGTTGGGGTTTATTACTGCATGCAGVNACTCSRMVBCC CTCCTTWCACTTTTGGCGGAGGGACCAAG | ATGCAGVNACTCSRMVBCCCTCC TTWCACT | 3159 | 3621 |
| VK2-28_t3_1_10 | GCTGAGGATGTTGGGGTTTATTACTGCATGCAGVNACTCSRMVBCC CTCCTMTCACTTTTGGCGGAGGGACCAAG | ATGCAGVNACTCSRMVBCCCTCC TMTCACT | 3160 | 3622 |
| VK2-28_t3_2_10 | GCTGAGGATGTTGGGGTTTATTACTGCATGCAGVNACTCSRMVBCC CTCCTWGGACTTTTGGCGGAGGGACCAAG | ATGCAGVNACTCSRMVBCCCTCC TWGGACT | 3161 | 3623 |
| VK2-28_t4_0_10 | GCTGAGGATGTTGGGGTTTATTACTGCATGCAGGCAMNASRMVBCC CTCCTTWCACTTTTGGCGGAGGGACCAAG | ATGCAGGCAMNASRMVBCCCTCC TTWCACT | 3162 | 3624 |
| VK2-28_t4_1_10 | GCTGAGGATGTTGGGGTTTATTACTGCATGCAGGCAMNASRMVBCC CTCCTMTCACTTTTGGCGGAGGGACCAAG | ATGCAGGCAMNASRMVBCCCTCC TMTCACT | 3163 | 3625 |
| VK2-28_t4_2_10 | GCTGAGGATGTTGGGGTTTATTACTGCATGCAGGCAMNASRMVBCC CTCCTWGGACTTTTGGCGGAGGGACCAAG | ATGCAGGCAMNASRMVBCCCTCC TWGGACT | 3164 | 3626 |
| VK3-11_t1_0_10 | CCTGAAGATTTTGCAGTTTATTACTGTCAGCAGBHCNHCNHCTGGC CTCCTTWCACTTTTGGCGGAGGGACCAAG | CAGCAGBHCNHCNHCTGGCCTCC TTWCACT | 3165 | 3627 |
| VK3-11_t1_1_10 | CCTGAAGATTTTGCAGTTTATTACTGTCAGCAGBHCNHCNHCTGGC CTCCTMTCACTTTTGGCGGAGGGACCAAG | CAGCAGBHCNHCNHCTGGCCTCC TMTCACT | 3166 | 3628 |
| VK3-11_t1_2_10 | CCTGAAGATTTTGCAGTTTATTACTGTCAGCAGBHCNHCNHCTGGC CTCCTWGGACTTTTGGCGGAGGGACCAAG | CAGCAGBHCNHCNHCTGGCCTCC TWGGACT | 3167 | 3629 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
|---|---|---|---|---|
| VK3-11_t2_0_10 | CCTGAAGATTTTGCAGTTTATTACTGTCAGCAGBHCNHCAATYWCCCTCCTTWCACTTTTGGCGGAGGGACCAAG | CAGCAGBHCNHCAATYWCCCTCCTTWCACT | 3168 | 3594 |
| VK3-11_t2_1_10 | CCTGAAGATTTTGCAGTTTATTACTGTCAGCAGBHCNHCAATYWCCCTCCTMTCACTTTTGGCGGAGGGACCAAG | CAGCAGBHCNHCAATYWCCCTCCTMTCACT | 3169 | 3595 |
| VK3-11_t2_2_10 | CCTGAAGATTTTGCAGTTTATTACTGTCAGCAGBHCNHCAATYWCCCTCCTWGGACTTTTGGCGGAGGGACCAAG | CAGCAGBHCNHCAATYWCCCTCCTWGGACT | 3170 | 3596 |
| VK3-11_t3_0_10 | CCTGAAGATTTTGCAGTTTATTACTGTCAGCAGBHCAGTNHCYWCCCTCCTTWCACTTTTGGCGGAGGGACCAAG | CAGCAGBHCAGTNHCYWCCCTCCTTWCACT | 3171 | 3630 |
| VK3-11_t3_1_10 | CCTGAAGATTTTGCAGTTTATTACTGTCAGCAGBHCAGTNHCYWCCCTCCTMTCACTTTTGGCGGAGGGACCAAG | CAGCAGBHCAGTNHCYWCCCTCCTMTCACT | 3172 | 3631 |
| VK3-11_t3_2_10 | CCTGAAGATTTTGCAGTTTATTACTGTCAGCAGBHCAGTNHCYWCCCTCCTWGGACTTTTGGCGGAGGGACCAAG | CAGCAGBHCAGTNHCYWCCCTCCTWGGACT | 3173 | 3632 |
| VK3-11_t4_0_10 | CCTGAAGATTTTGCAGTTTATTACTGTCAGCAGAGANHCNHCYWCCCTCCTTWCACTTTTGGCGGAGGGACCAAG | CAGCAGAGANHCNHCYWCCCTCCTTWCACT | 3174 | 3633 |
| VK3-11_t4_1_10 | CCTGAAGATTTTGCAGTTTATTACTGTCAGCAGAGANHCNHCYWCCCTCCTMTCACTTTTGGCGGAGGGACCAAG | CAGCAGAGANHCNHCYWCCCTCCTMTCACT | 3175 | 3634 |
| VK3-11_t4_2_10 | CCTGAAGATTTTGCAGTTTATTACTGTCAGCAGAGANHCNHCYWCCCTCCTWGGACTTTTGGCGGAGGGACCAAG | CAGCAGAGANHCNHCYWCCCTCCTWGGACT | 3176 | 3635 |
| VK3-15_t1_0_10 | CAGTCTGAAGATTTTGCAGTTTATTACTGTCAGCAGBHCNHCNHCTGGCCTCCTTWCACTTTTGGCGGAGGGACCAAG | CAGCAGBHCNHCNHCTGGCCTCCTTWCACT | 3177 | 3627 |
| VK3-15_t1_1_10 | CAGTCTGAAGATTTTGCAGTTTATTACTGTCAGCAGBHCNHCNHCTGGCCTCCTMTCACTTTTGGCGGAGGGACCAAG | CAGCAGBHCNHCNHCTGGCCTCCTMTCACT | 3178 | 3628 |
| VK3-15_t1_2_10 | CAGTCTGAAGATTTTGCAGTTTATTACTGTCAGCAGBHCNHCNHCTGGCCTCCTWGGACTTTTGGCGGAGGGACCAAG | CAGCAGBHCNHCNHCTGGCCTCCTWGGACT | 3179 | 3629 |
| VK3-15_t2_0_10 | CAGTCTGAAGATTTTGCAGTTTATTACTGTCAGCAGBHCNHCAATYWCCCTCCTTWCACTTTTGGCGGAGGGACCAAG | CAGCAGBHCNHCAATYWCCCTCCTTWCACT | 3180 | 3594 |
| VK3-15_t2_1_10 | CAGTCTGAAGATTTTGCAGTTTATTACTGTCAGCAGBHCNHCAATYWCCCTCCTMTCACTTTTGGCGGAGGGACCAAG | CAGCAGBHCNHCAATYWCCCTCCTMTCACT | 3181 | 3595 |
| VK3-15_t2_2_10 | CAGTCTGAAGATTTTGCAGTTTATTACTGTCAGCAGBHCNHCAATYWCCCTCCTWGGACTTTTGGCGGAGGGACCAAG | CAGCAGBHCNHCAATYWCCCTCCTWGGACT | 3182 | 3596 |
| VK3-15_t3_0_10 | CAGTCTGAAGATTTTGCAGTTTATTACTGTCAGCAGBHCAATNHCYWCCCTCCTTWCACTTTTGGCGGAGGGACCAAG | CAGCAGBHCAATNHCYWCCCTCCTTWCACT | 3183 | 3636 |
| VK3-15_t3_1_10 | CAGTCTGAAGATTTTGCAGTTTATTACTGTCAGCAGBHCAATNHCYWCCCTCCTMTCACTTTTGGCGGAGGGACCAAG | CAGCAGBHCAATNHCYWCCCTCCTMTCACT | 3184 | 3637 |
| VK3-15_t3_2_10 | CAGTCTGAAGATTTTGCAGTTTATTACTGTCAGCAGBHCAATNHCYWCCCTCCTWGGACTTTTGGCGGAGGGACCAAG | CAGCAGBHCAATNHCYWCCCTCCTWGGACT | 3185 | 3638 |
| VK3-15_t4_0_10 | CAGTCTGAAGATTTTGCAGTTTATTACTGTCAGCAGTACNHCNHCYWCCCTCCTTWCACTTTTGGCGGAGGGACCAAG | CAGCAGTACNHCNHCYWCCCTCCTTWCACT | 3186 | 3600 |
| VK3-15_t4_1_10 | CAGTCTGAAGATTTTGCAGTTTATTACTGTCAGCAGTACNHCNHCYWCCCTCCTMTCACTTTTGGCGGAGGGACCAAG | CAGCAGTACNHCNHCYWCCCTCCTMTCACT | 3187 | 3601 |
| VK3-15_t4_2_10 | CAGTCTGAAGATTTTGCAGTTTATTACTGTCAGCAGTACNHCNHCYWCCCTCCTWGGACTTTTGGCGGAGGGACCAAG | CAGCAGTACNHCNHCYWCCCTCCTWGGACT | 3188 | 3602 |
| VK3-20_t1_0_10 | CCTGAAGATTTTGCAGTGTATTACTGTCAGCAGBHCBHCVNCAGTCCTCCTTWCACTTTTGGCGGAGGGACCAAG | CAGCAGBHCBHCVNCAGTCCTCCTTWCACT | 3189 | 3639 |
| VK3-20_t1_1_10 | CCTGAAGATTTTGCAGTGTATTACTGTCAGCAGBHCBHCVNCAGTCCTCCTMTCACTTTTGGCGGAGGGACCAAG | CAGCAGBHCBHCVNCAGTCCTCCTMTCACT | 3190 | 3640 |
| VK3-20_t1_2_10 | CCTGAAGATTTTGCAGTGTATTACTGTCAGCAGBHCBHCVNCAGTCCTCCTWGGACTTTTGGCGGAGGGACCAAG | CAGCAGBHCBHCVNCAGTCCTCCTWGGACT | 3191 | 3641 |

TABLE 7-continued

Oligonucleotide sequences for exemplary VK jumping dimer and trimer sequences with CDRL3 length 10.

| Name | Sequence of Synthesized Oligonucleotide | Portion of Oligonucleotide Corresponding to CDRL3 Proper | SEQ ID NO (Oligo) | SEQ ID NO (CDRL3 Portion) |
| --- | --- | --- | --- | --- |
| VK3-20_t2_0_10 | CCTGAAGATTTTGCAGTGTATTACTGTCAGCAGBHCBHCAGTBHCCCTCCTTWCACTTTTGGCGGAGGGACCAAG | CAGCAGBHCBHCAGTBHCCCTCCTTWCACT | 3192 | 3642 |
| VK3-20_t2_1_10 | CCTGAAGATTTTGCAGTGTATTACTGTCAGCAGBHCBHCAGTBHCCCTCCTMTCACTTTTGGCGGAGGGACCAAG | CAGCAGBHCBHCAGTBHCCCTCCTMTCACT | 3193 | 3643 |
| VK3-20_t2_2_10 | CCTGAAGATTTTGCAGTGTATTACTGTCAGCAGBHCBHCAGTBHCCCTCCTWGGACTTTTGGCGGAGGGACCAAG | CAGCAGBHCBHCAGTBHCCCTCCTWGGACT | 3194 | 3644 |
| VK3-20_t3_0_10 | CCTGAAGATTTTGCAGTGTATTACTGTCAGCAGBHCGGAVNCBHCCCTCCTTWCACTTTTGGCGGAGGGACCAAG | CAGCAGBHCGGAVNCBHCCCTCCTTWCACT | 3195 | 3645 |
| VK3-20_t3_1_10 | CCTGAAGATTTTGCAGTGTATTACTGTCAGCAGBHCGGAVNCBHCCCTCCTMTCACTTTTGGCGGAGGGACCAAG | CAGCAGBHCGGAVNCBHCCCTCCTMTCACT | 3196 | 3646 |
| VK3-20_t3_2_10 | CCTGAAGATTTTGCAGTGTATTACTGTCAGCAGBHCGGAVNCBHCCCTCCTWGGACTTTTGGCGGAGGGACCAAG | CAGCAGBHCGGAVNCBHCCCTCCTWGGACT | 3197 | 3647 |
| VK3-20_t4_0_10 | CCTGAAGATTTTGCAGTGTATTACTGTCAGCAGTACBHCVNCBHCCCTCCTTWCACTTTTGGCGGAGGGACCAAG | CAGCAGTACBHCVNCBHCCCTCCTTWCACT | 3198 | 3648 |
| VK3-20_t4_1_10 | CCTGAAGATTTTGCAGTGTATTACTGTCAGCAGTACBHCVNCBHCCCTCCTMTCACTTTTGGCGGAGGGACCAAG | CAGCAGTACBHCVNCBHCCCTCCTMTCACT | 3199 | 3649 |
| VK3-20_t4_2_10 | CCTGAAGATTTTGCAGTGTATTACTGTCAGCAGTACBHCVNCBHCCCTCCTWGGACTTTTGGCGGAGGGACCAAG | CAGCAGTACBHCVNCBHCCCTCCTWGGACT | 3200 | 3650 |
| VK4-01_t1_0_10 | GCTGAAGATGTGGCAGTTTATTACTGTCAGCAGBHCBHCNHCACTCCTCCTTWCACTTTTGGCGGAGGGACCAAG | CAGCAGBHCBHCNHCACTCCTCCTTWCACT | 3201 | 3651 |
| VK4-01_t1_1_10 | GCTGAAGATGTGGCAGTTTATTACTGTCAGCAGBHCBHCNHCACTCCTCCTMTCACTTTTGGCGGAGGGACCAAG | CAGCAGBHCBHCNHCACTCCTCCTMTCACT | 3202 | 3652 |
| VK4-01_t1_2_10 | GCTGAAGATGTGGCAGTTTATTACTGTCAGCAGBHCBHCNHCACTCCTCCTWGGACTTTTGGCGGAGGGACCAAG | CAGCAGBHCBHCNHCACTCCTCCTWGGACT | 3203 | 3653 |
| VK4-01_t2_0_10 | GCTGAAGATGTGGCAGTTTATTACTGTCAGCAGBHCBHCAGTBHCCCTCCTTWCACTTTTGGCGGAGGGACCAAG | CAGCAGBHCBHCAGTBHCCCTCCTTWCACT | 3204 | 3642 |
| VK4-01_t2_1_10 | GCTGAAGATGTGGCAGTTTATTACTGTCAGCAGBHCBHCAGTBHCCCTCCTMTCACTTTTGGCGGAGGGACCAAG | CAGCAGBHCBHCAGTBHCCCTCCTMTCACT | 3205 | 3643 |
| VK4-01_t2_2_10 | GCTGAAGATGTGGCAGTTTATTACTGTCAGCAGBHCBHCAGTBHCCCTCCTWGGACTTTTGGCGGAGGGACCAAG | CAGCAGBHCBHCAGTBHCCCTCCTWGGACT | 3206 | 3644 |
| VK4-01_t3_0_10 | GCTGAAGATGTGGCAGTTTATTACTGTCAGCAGBHCTACNHCBHCCCTCCTTWCACTTTTGGCGGAGGGACCAAG | CAGCAGBHCTACNHCBHCCCTCCTTWCACT | 3207 | 3654 |
| VK4-01_t3_1_10 | GCTGAAGATGTGGCAGTTTATTACTGTCAGCAGBHCTACNHCBHCCCTCCTMTCACTTTTGGCGGAGGGACCAAG | CAGCAGBHCTACNHCBHCCCTCCTMTCACT | 3208 | 3655 |
| VK4-01_t3_2_10 | GCTGAAGATGTGGCAGTTTATTACTGTCAGCAGBHCTACNHCBHCCCTCCTWGGACTTTTGGCGGAGGGACCAAG | CAGCAGBHCTACNHCBHCCCTCCTWGGACT | 3209 | 3656 |
| VK4-01_t4_0_10 | GCTGAAGATGTGGCAGTTTATTACTGTCAGCAGTACBHCNHCBHCCCTCCTTWCACTTTTGGCGGAGGGACCAAG | CAGCAGTACBHCNHCBHCCCTCCTTWCACT | 3210 | 3657 |
| VK4-01_t4_1_10 | GCTGAAGATGTGGCAGTTTATTACTGTCAGCAGTACBHCNHCBHCCCTCCTMTCACTTTTGGCGGAGGGACCAAG | CAGCAGTACBHCNHCBHCCCTCCTMTCACT | 3211 | 3658 |
| VK4-01_t4_2_10 | GCTGAAGATGTGGCAGTTTATTACTGTCAGCAGTACBHCNHCBHCCCTCCTWGGACTTTTGGCGGAGGGACCAAG | CAGCAGTACBHCNHCBHCCCTCCTWGGACT | 3212 | 3659 |

TABLE 8

Number of unique CDRL3 amino acid sequences in exemplary jumping dimer ("JD") and jumping trimer ("JT") VK libraries and comparison to VK-v1.0.

| | L = 8 aa | | L = 9 aa | | L = 10 aa | |
|---|---|---|---|---|---|---|
| | Jumping Dimer | | | | | |
| Germline | JD | VK-v1.0 | JD | VK-v1.0 | JD | VK-v1.0 |
| VK1-05 | 3549 | 3072 | 7098 | 6144 | 6084 | 13824 |
| VK1-12 | 5250 | 2016 | 5250 | 2016 | 4500 | 5184 |
| VK1-33 | 5502 | 4032 | 5502 | 4032 | 4716 | 10368 |
| VK1-39 | 7224 | 3024 | 7224 | 3024 | 6192 | 7776 |
| VK2-28 | 4396 | 2016 | 4396 | 2016 | 3768 | 5184 |
| VK3-11 | 6048 | 2352 | 6048 | 2016 | 5184 | 6048 |
| VK3-15 | 5789 | 2016 | 5789 | 2352 | 4962 | 5184 |
| VK3-20 | 6405 | 2016 | 6671 | 2016 | 5490 | 5184 |
| VK4-01 | NPE* | 2016 | 6405 | 2592 | NPE* | 5184 |
| Total | $4.42 * 10^4$ | $2.26 * 10^4$ | $5.44 * 10^4$ | $2.62 * 10^4$ | $4.09 * 10^4$ | $6.39 * 10^4$ |
| | Jumping Trimer | | | | | |
| Germline | JT | VK-v1.0 | JT | VK-v1.0 | JT | VK-v1.0 |
| VK1-05 | 7872 | 3072 | 13776 | 6144 | 11808 | 13824 |
| VK1-12 | 14469 | 2016 | 14469 | 2016 | 12402 | 5184 |
| VK1-33 | 15960 | 4032 | 15960 | 4032 | 13680 | 10368 |
| VK1-39 | 28980 | 3024 | 28980 | 3024 | 24840 | 7776 |
| VK2-28 | 12306 | 2016 | 12306 | 2016 | 10548 | 5184 |
| VK3-11 | 18900 | 2352 | 18900 | 2016 | 16200 | 6048 |
| VK3-15 | 18256 | 2016 | 18256 | 2352 | 15648 | 5184 |
| VK3-20 | 23688 | 2016 | 23688 | 2016 | 20304 | 5184 |
| VK4-01 | 23688 | 2016 | 23688 | 2592 | 20304 | 5184 |
| Total | $1.64 * 10^5$ | $2.26 * 10^4$ | $1.70 * 10^5$ | $2.62 * 10^4$ | $1.46 * 10^5$ | $6.39 * 10^4$ |

*Not Presently Exemplified. However, given the teachings of the specification, a person of ordinary skill in the art could readily produce a library of such lengths, and these lengths are included within the scope of the invention.

TABLE 9

Matching output for exemplary CDRH3 sequences from the HPS and TSP1. Amino acid mismatches in the theoretical design are indicated in bold.

| Test CDRH3 Sequence Case from HPS | SEQ ID NO | Mismatches | TN1 | SEQ ID NO | DH | SEQ ID NO | N2 | H3-JH | SEQ ID NO |
|---|---|---|---|---|---|---|---|---|---|
| 1    RTAHHFDY | 3660 | 0 | R | | TA | | H | HFDY | 4582 |
| 2.1  VGIVGAASY | 3661 | 0 | V | | GIVGA | 3751 | AS | Y | |
| 2.2  VGIVGAASY | 3661 | 0 | VG | | IVGA | 3755 | AS | Y | |
| 3.1  DRYSGHDLGY | 3662 | 1 | DR | | YSGYD | 4389 | LG | Y | |
| 4.1  GIAAADSNWLDP | 3663 | 1 | – | | GIAAA | 4448 | D | SNWFDP | 4600 |
| 4.2  GIAAADSNWLDP | 3663 | 1 | – | | IAAA | 4452 | D | SNWFDP | 4600 |
| 5.1  ERTINWGWGGVYAFDI | 3664 | 3 | EGTG | 3707 | NWG | | GGV | YAFDI | 4540 |
| 5.2  ERTINWGWGGVYAFDI | 3663 | 3 | EGTG | 3707 | NWG | | WGT | YAFDI | 4540 |
| 5.3  ERTINWGWGGVYAFDI | 3664 | 3 | ERGG | 3719 | NWG | | GGV | YAFDI | 4540 |
| 5.4  ERTINWGWGGVYAFDI | 3664 | 3 | ERGG | 3719 | NWG | | WGT | YAFDI | 4540 |

TABLE 10

Theoretical segment pool of 212 TN1 sequences contained in Theoretical Segment Pool 1 (TSP1).

| TN1 Segment Name | Amino Acid Sequence | TN1 Segment Name | Amino Acid Sequence | SEQ ID NO |
|---|---|---|---|---|
| P000 | — | P107 | PT | n/a |
| P001 | E | P108 | EPT | n/a |
| P002 | D | P109 | DPT | n/a |
| P003 | G | P110 | GPT | n/a |
| P004 | EG | P111 | PV | n/a |
| P005 | DG | P112 | EPV | n/a |
| P006 | GG | P113 | DPV | n/a |
| P007 | R | P114 | GPV | n/a |
| P008 | ER | P115 | RP | n/a |
| P009 | DR | P116 | ERP | n/a |
| P010 | GR | P117 | DRP | n/a |
| P011 | S | P118 | GRP | n/a |
| P012 | ES | P119 | SP | n/a |
| P013 | DS | P120 | ESP | n/a |
| P014 | GS | P121 | DSP | n/a |
| P015 | P | P122 | GSP | n/a |
| P016 | EP | P123 | LP | n/a |
| P017 | DP | P124 | ELP | n/a |
| P018 | GP | P125 | DLP | n/a |
| P019 | L | P126 | GLP | n/a |
| P020 | EL | P127 | AP | n/a |
| P021 | DL | P128 | EAP | n/a |
| P022 | GL | P129 | DAP | n/a |
| P023 | A | P130 | GAP | n/a |
| P024 | EA | P131 | TP | n/a |
| P025 | DA | P132 | ETP | n/a |
| P026 | GA | P133 | DTP | n/a |
| P027 | T | P134 | GTP | n/a |
| P028 | ET | P135 | VP | n/a |
| P029 | DT | P136 | EVP | n/a |
| P030 | GT | P137 | DVP | n/a |
| P031 | V | P138 | GVP | n/a |
| P032 | EV | P139 | AGG | n/a |
| P033 | DV | P140 | EAGG | 3665 |
| P034 | GV | P141 | DAGG | 3666 |
| P035 | EGG | P142 | GAGG | 3667 |
| P036 | DGG | P143 | EGAG | 3668 |
| P037 | GGG | P144 | DGAG | 3669 |
| P038 | EGR | P145 | GGAG | 3670 |
| P039 | DGR | P146 | EGGA | 3671 |
| P040 | GGR | P147 | DGGA | 3672 |
| P041 | EGS | P148 | GGGA | 3673 |
| P042 | DGS | P149 | EGGG | 3674 |
| P043 | GGS | P150 | DGGG | 3675 |
| P044 | EGP | P151 | GGGG | 3676 |
| P045 | DGP | P152 | EGGL | 3677 |
| P046 | GGP | P153 | DGGL | 3678 |
| P047 | EGL | P154 | GGGL | 3679 |
| P048 | DGL | P155 | EGGP | 3680 |
| P049 | GGL | P156 | DGGP | 3681 |
| P050 | EGA | P157 | GGGP | 3682 |
| P051 | DGA | P158 | EGGR | 3683 |
| P052 | GGA | P159 | DGGR | 3684 |
| P053 | EGT | P160 | GGGR | 3685 |
| P054 | DGT | P161 | EGGS | 3686 |
| P055 | GGT | P162 | DGGS | 3687 |
| P056 | EGV | P163 | GGGS | 3688 |
| P057 | DGV | P164 | EGGT | 3689 |
| P058 | GGV | P165 | DGGT | 3690 |
| P059 | RG | P166 | GGGT | 3691 |
| P060 | ERG | P167 | EGGV | 3692 |
| P061 | DRG | P168 | DGGV | 3693 |
| P062 | GRG | P169 | GGGV | 3694 |
| P063 | SG | P170 | EGLG | 3695 |
| P064 | ESG | P171 | DGLG | 3696 |
| P065 | DSG | P172 | GGLG | 3697 |
| P066 | GSG | P173 | EGPG | 3698 |
| P067 | PG | P174 | DGPG | 3699 |
| P068 | EPG | P175 | GGPG | 3700 |
| P069 | DPG | P176 | EGRG | 3701 |
| P070 | GPG | P177 | DGRG | 3702 |
| P071 | LG | P178 | GGRG | 3703 |
| P072 | ELG | P179 | EGSG | 3704 |

TABLE 10-continued

Theoretical segment pool of 212 TN1 sequences contained in Theoretical Segment Pool 1 (TSP1).

| TN1 Segment Name | Amino Acid Sequence | TN1 Segment Name | Amino Acid Sequence | SEQ ID NO |
|---|---|---|---|---|
| P073 | DLG | P180 | DGSG | 3705 |
| P074 | GLG | P181 | GGSG | 3706 |
| P075 | AG | P182 | EGTG | 3707 |
| P076 | EAG | P183 | DGTG | 3708 |
| P077 | DAG | P184 | GGTG | 3709 |
| P078 | GAG | P185 | EGVG | 3710 |
| P079 | TG | P186 | DGVG | 3711 |
| P080 | ETG | P187 | GGVG | 3712 |
| P081 | DTG | P188 | LGG | n/a |
| P082 | GTG | P189 | ELGG | 3713 |
| P083 | VG | P190 | DLGG | 3714 |
| P084 | EVG | P191 | GLGG | 3715 |
| P085 | DVG | P192 | PGG | n/a |
| P086 | GVG | P193 | EPGG | 3716 |
| P087 | PR | P194 | DPGG | 3717 |
| P088 | EPR | P195 | GPGG | 3718 |
| P089 | DPR | P196 | RGG | n/a |
| P090 | GPR | P197 | ERGG | 3719 |
| P091 | PS | P198 | DRGG | 3720 |
| P092 | EPS | P199 | GRGG | 3721 |
| P093 | DPS | P200 | SGG | n/a |
| P094 | GPS | P201 | ESGG | 3722 |
| P095 | PP | P202 | DSGG | 3723 |
| P096 | EPP | P203 | GSGG | 3724 |
| P097 | DPP | P204 | TGG | n/a |
| P098 | GPP | P205 | ETGG | 3725 |
| P099 | PL | P206 | DTGG | 3726 |
| P100 | EPL | P207 | GTGG | 3727 |
| P101 | DPL | P208 | VGG | n/a |
| P102 | GPL | P209 | EVGG | 3728 |
| P103 | PA | P210 | DVGG | 3729 |
| P104 | EPA | P211 | GVGG | 3730 |
| P105 | DPA | | | |
| P106 | GPA | | | |

TABLE 11

1K DH Theoretical Segment Pool sequences (1,111 DH segments).

| DH Segment Name | Amino Acid Sequence | SEQ ID NO |
|---|---|---|
| DHUNIV_001 | GTTGTT | 3731 |
| DHUNIV_002 | GTTGT | 3732 |
| DHUNIV_003 | TTGTT | 3733 |
| DHUNIV_004 | GTTG | 3734 |
| DHUNIV_005 | TTGT | 3735 |
| DHUNIV_006 | TGTT | 3736 |
| DHUNIV_007 | GTT | n/a |
| DHUNIV_008 | TTG | n/a |
| DHUNIV_009 | TGT | n/a |
| DHUNIV_010 | GT | n/a |
| DHUNIV_011 | TT | n/a |
| DHUNIV_012 | TG | n/a |
| DHUNIV_013 | VQLER | 3737 |
| DHUNIV_014 | VQLE | 3738 |
| DHUNIV_015 | QLER | 3739 |
| DHUNIV_016 | VQL | n/a |
| DHUNIV_017 | QLE | n/a |
| DHUNIV_018 | LER | n/a |
| DHUNIV_019 | VQ | n/a |
| DHUNIV_020 | QL | n/a |
| DHUNIV_021 | LE | n/a |
| DHUNIV_022 | ER | n/a |
| DHUNIV_023 | YNWND | 3740 |
| DHUNIV_024 | YNWN | 3741 |
| DHUNIV_025 | NWND | 3742 |
| DHUNIV_026 | YNW | n/a |
| DHUNIV_027 | NWN | n/a |
| DHUNIV_028 | WND | n/a |
| DHUNIV_029 | YN | n/a |
| DHUNIV_030 | NW | n/a |
| DHUNIV_031 | WN | n/a |
| DHUNIV_032 | ND | n/a |
| DHUNIV_033 | GITGTT | 3743 |
| DHUNIV_034 | GITGT | 3744 |
| DHUNIV_035 | ITGTT | 3745 |
| DHUNIV_036 | GITG | 3746 |
| DHUNIV_037 | ITGT | 3747 |

TABLE 11-continued

1K DH Theoretical Segment Pool sequences (1,111 DH segments).

| DH Segment Name | Amino Acid Sequence | SEQ ID NO |
|---|---|---|
| DHUNIV_038 | GIT | n/a |
| DHUNIV_039 | ITG | n/a |
| DHUNIV_040 | GI | n/a |
| DHUNIV_041 | IT | n/a |
| DHUNIV_042 | GIVGATT | 3748 |
| DHUNIV_043 | GIVGAT | 3749 |
| DHUNIV_044 | IVGATT | 3750 |
| DHUNIV_045 | GIVGA | 3751 |
| DHUNIV_046 | IVGAT | 3752 |
| DHUNIV_047 | VGATT | 3753 |
| DHUNIV_048 | GIVG | 3754 |
| DHUNIV_049 | IVGA | 3755 |
| DHUNIV_050 | VGAT | 3756 |
| DHUNIV_051 | GATT | 3757 |
| DHUNIV_052 | GIV | n/a |
| DHUNIV_053 | IVG | n/a |
| DHUNIV_054 | VGA | n/a |
| DHUNIV_055 | GAT | n/a |
| DHUNIV_056 | ATT | n/a |
| DHUNIV_057 | IV | n/a |
| DHUNIV_058 | VG | n/a |
| DHUNIV_059 | GA | n/a |
| DHUNIV_060 | AT | n/a |
| DHUNIV_061 | WELL | 3758 |
| DHUNIV_062 | WEL | n/a |
| DHUNIV_063 | ELL | n/a |
| DHUNIV_064 | WE | n/a |
| DHUNIV_065 | EL | n/a |
| DHUNIV_066 | LL | n/a |
| DHUNIV_067 | YSGSYY | 3759 |
| DHUNIV_068 | YSGSY | 3760 |
| DHUNIV_069 | SGSYY | 3761 |
| DHUNIV_070 | YSGS | 3762 |
| DHUNIV_071 | SGSY | 3763 |
| DHUNIV_072 | GSYY | 3764 |
| DHUNIV_073 | YSG | n/a |
| DHUNIV_074 | SGS | n/a |
| DHUNIV_075 | GSY | n/a |
| DHUNIV_076 | SYY | n/a |
| DHUNIV_077 | YS | n/a |
| DHUNIV_078 | SG | n/a |
| DHUNIV_079 | GS | n/a |
| DHUNIV_080 | SY | n/a |
| DHUNIV_081 | YY | n/a |
| DHUNIV_082 | LEL | n/a |
| DHUNIV_083 | YNWNY | 3765 |
| DHUNIV_084 | NWNY | 3766 |
| DHUNIV_085 | WNY | n/a |
| DHUNIV_086 | NY | n/a |
| DHUNIV_087 | RIL | n/a |
| DHUNIV_088 | LLL | n/a |
| DHUNIV_089 | RI | n/a |
| DHUNIV_090 | IL | n/a |
| DHUNIV_091 | WW | n/a |
| DHUNIV_092 | GYCSGGSCYS | 3767 |
| DHUNIV_093 | GYCSGGSCY | 3768 |
| DHUNIV_094 | YCSGGSCYS | 3769 |
| DHUNIV_095 | GYCSGGSC | 3770 |
| DHUNIV_096 | YCSGGSCY | 3771 |
| DHUNIV_097 | CSGGSCYS | 3772 |
| DHUNIV_098 | YCSGGSC | 3773 |
| DHUNIV_099 | CSGGSCY | 3774 |
| DHUNIV_100 | CSGGSC | 3775 |
| DHUNIV_101 | SGGS | 3776 |
| DHUNIV_102 | SGG | n/a |
| DHUNIV_103 | GGS | n/a |
| DHUNIV_104 | GY | n/a |
| DHUNIV_105 | GG | n/a |
| DHUNIV_106 | DIVVVAATP | 3777 |
| DHUNIV_107 | DIVVVAAT | 3778 |
| DHUNIV_108 | IVVVAATP | 3779 |
| DHUNIV_109 | DIVVVAA | 3780 |
| DHUNIV_110 | IVVVAAT | 3781 |
| DHUNIV_111 | VVVVAATP | 3782 |

TABLE 11-continued

1K DH Theoretical Segment Pool sequences (1,111 DH segments).

| DH Segment Name | Amino Acid Sequence | SEQ ID NO |
|---|---|---|
| DHUNIV_112 | DIVVVVA | 3783 |
| DHUNIV_113 | IVVVVAA | 3784 |
| DHUNIV_114 | VVVVAAT | 3785 |
| DHUNIV_115 | VVVAATP | 3786 |
| DHUNIV_116 | DIVVVV | 3787 |
| DHUNIV_117 | IVVVVA | 3788 |
| DHUNIV_118 | VVVVAA | 3789 |
| DHUNIV_119 | VVVAAT | 3790 |
| DHUNIV_120 | VVAATP | 3791 |
| DHUNIV_121 | DIVVV | 3792 |
| DHUNIV_122 | IVVVV | 3793 |
| DHUNIV_123 | VVVVA | 3794 |
| DHUNIV_124 | VVVAA | 3795 |
| DHUNIV_125 | VVAAT | 3796 |
| DHUNIV_126 | VAATP | 3797 |
| DHUNIV_127 | DIVV | 3798 |
| DHUNIV_128 | IVVV | 3799 |
| DHUNIV_129 | VVVV | 3800 |
| DHUNIV_130 | VVVA | 3801 |
| DHUNIV_131 | VVAA | 3802 |
| DHUNIV_132 | VAAT | 3803 |
| DHUNIV_133 | AATP | 3804 |
| DHUNIV_134 | DIV | n/a |
| DHUNIV_135 | IVV | n/a |
| DHUNIV_136 | VVV | n/a |
| DHUNIV_137 | VVA | n/a |
| DHUNIV_138 | VAA | n/a |
| DHUNIV_139 | AAT | n/a |
| DHUNIV_140 | ATP | n/a |
| DHUNIV_141 | DI | n/a |
| DHUNIV_142 | VV | n/a |
| DHUNIV_143 | VA | n/a |
| DHUNIV_144 | AA | n/a |
| DHUNIV_145 | TP | n/a |
| DHUNIV_146 | YQLL | 3805 |
| DHUNIV_147 | YQL | n/a |
| DHUNIV_148 | QLL | n/a |
| DHUNIV_149 | YQ | n/a |
| DHUNIV_150 | GYCSSTSCYA | 3806 |
| DHUNIV_151 | GYCSSTSCY | 3807 |
| DHUNIV_152 | YCSSTSCYA | 3808 |
| DHUNIV_153 | GYCSSTSC | 3809 |
| DHUNIV_154 | YCSSTSCY | 3810 |
| DHUNIV_155 | CSSTSCYA | 3811 |
| DHUNIV_156 | YCSSTSC | 3812 |
| DHUNIV_157 | CSSTSCY | 3813 |
| DHUNIV_158 | CSSTSC | 3814 |
| DHUNIV_159 | SSTS | 3815 |
| DHUNIV_160 | SST | n/a |
| DHUNIV_161 | STS | n/a |
| DHUNIV_162 | SS | n/a |
| DHUNIV_163 | ST | n/a |
| DHUNIV_164 | TS | n/a |
| DHUNIV_165 | YA | n/a |
| DHUNIV_166 | DIVVVPAAMP | 3816 |
| DHUNIV_167 | DIVVVPAAM | 3817 |
| DHUNIV_168 | IVVVPAAMP | 3818 |
| DHUNIV_169 | DIVVVPAA | 3819 |
| DHUNIV_170 | IVVVPAAM | 3820 |
| DHUNIV_171 | VVVPAAMP | 3821 |
| DHUNIV_172 | DIVVVPA | 3822 |
| DHUNIV_173 | IVVVPAA | 3823 |
| DHUNIV_174 | VVVPAAM | 3824 |
| DHUNIV_175 | VVPAAMP | 3825 |
| DHUNIV_176 | DIVVVP | 3826 |
| DHUNIV_177 | IVVVPA | 3827 |
| DHUNIV_178 | VVVPAA | 3828 |
| DHUNIV_179 | VVPAAM | 3829 |
| DHUNIV_180 | VPAAMP | 3830 |
| DHUNIV_181 | IVVVP | 3831 |
| DHUNIV_182 | VVVPA | 3832 |
| DHUNIV_183 | VVPAA | 3833 |
| DHUNIV_184 | VPAAM | 3834 |
| DHUNIV_185 | PAAMP | 3835 |

TABLE 11-continued

1K DH Theoretical Segment Pool sequences (1,111 DH segments).

| DH Segment Name | Amino Acid Sequence | SEQ ID NO |
|---|---|---|
| DHUNIV_186 | VVVP | 3836 |
| DHUNIV_187 | VVPA | 3837 |
| DHUNIV_188 | VPAA | 3838 |
| DHUNIV_189 | PAAM | 3839 |
| DHUNIV_190 | AAMP | 3840 |
| DHUNIV_191 | VVP | n/a |
| DHUNIV_192 | VPA | n/a |
| DHUNIV_193 | PAA | n/a |
| DHUNIV_194 | AAM | n/a |
| DHUNIV_195 | AMP | n/a |
| DHUNIV_196 | VP | n/a |
| DHUNIV_197 | PA | n/a |
| DHUNIV_198 | AM | n/a |
| DHUNIV_199 | MP | n/a |
| DHUNIV_200 | YQLLY | 3841 |
| DHUNIV_201 | QLLY | 3842 |
| DHUNIV_202 | LLY | n/a |
| DHUNIV_203 | LY | n/a |
| DHUNIV_204 | GYCSSTSCYT | 3843 |
| DHUNIV_205 | YCSSTSCYT | 3844 |
| DHUNIV_206 | CSSTSCYT | 3845 |
| DHUNIV_207 | YT | n/a |
| DHUNIV_208 | DIVVPAAIP | 3846 |
| DHUNIV_209 | DIVVPAAI | 3847 |
| DHUNIV_210 | IVVVPAAIP | 3848 |
| DHUNIV_211 | IVVVPAAI | 3849 |
| DHUNIV_212 | VVVPAAIP | 3850 |
| DHUNIV_213 | VVVPAAI | 3851 |
| DHUNIV_214 | VVPAAIP | 3852 |
| DHUNIV_215 | VVPAAI | 3853 |
| DHUNIV_216 | VPAAIP | 3854 |
| DHUNIV_217 | VPAAI | 3855 |
| DHUNIV_218 | PAAIP | 3856 |
| DHUNIV_219 | PAAI | 3857 |
| DHUNIV_220 | AAIP | 3858 |
| DHUNIV_221 | AAI | n/a |
| DHUNIV_222 | AIP | n/a |
| DHUNIV_223 | AI | n/a |
| DHUNIV_224 | IP | n/a |
| DHUNIV_225 | WIL | n/a |
| DHUNIV_226 | WI | n/a |
| DHUNIV_227 | SILWW | 3859 |
| DHUNIV_228 | SILW | 3860 |
| DHUNIV_229 | ILWW | 3861 |
| DHUNIV_230 | SIL | n/a |
| DHUNIV_231 | ILW | n/a |
| DHUNIV_232 | LWW | n/a |
| DHUNIV_233 | LLF | n/a |
| DHUNIV_234 | SI | n/a |
| DHUNIV_235 | LW | n/a |
| DHUNIV_236 | LF | n/a |
| DHUNIV_237 | AYCGGDCYS | 3862 |
| DHUNIV_238 | AYCGGDCY | 3863 |
| DHUNIV_239 | YCGGDCYS | 3864 |
| DHUNIV_240 | AYCGGDC | 3865 |
| DHUNIV_241 | YCGGDCY | 3866 |
| DHUNIV_242 | CGGDCYS | 3867 |
| DHUNIV_243 | YCGGDC | 3868 |
| DHUNIV_244 | CGGDCY | 3869 |
| DHUNIV_245 | CGGDC | 3870 |
| DHUNIV_246 | GGD | n/a |
| DHUNIV_247 | AY | n/a |
| DHUNIV_248 | GD | n/a |
| DHUNIV_249 | HIVVVIAIP | 3871 |
| DHUNIV_250 | HIVVVIAI | 3872 |
| DHUNIV_251 | IVVVIAIP | 3873 |
| DHUNIV_252 | HIVVVIA | 3874 |
| DHUNIV_253 | IVVVIAI | 3875 |
| DHUNIV_254 | VVVIAIP | 3876 |
| DHUNIV_255 | HIVVVI | 3877 |
| DHUNIV_256 | IVVVIA | 3878 |
| DHUNIV_257 | VVVIAI | 3879 |
| DHUNIV_258 | VVIAIP | 3880 |
| DHUNIV_259 | HIVVV | 3881 |

TABLE 11-continued

1K DH Theoretical Segment Pool sequences (1,111 DH segments).

| DH Segment Name | Amino Acid Sequence | SEQ ID NO |
|---|---|---|
| DHUNIV_260 | IVVVI | 3882 |
| DHUNIV_261 | VVVIA | 3883 |
| DHUNIV_262 | VVIAI | 3884 |
| DHUNIV_263 | VIAIP | 3885 |
| DHUNIV_264 | HIVV | 3886 |
| DHUNIV_265 | VVVI | 3887 |
| DHUNIV_266 | VVIA | 3888 |
| DHUNIV_267 | VIAI | 3889 |
| DHUNIV_268 | IAIP | 3890 |
| DHUNIV_269 | HIV | n/a |
| DHUNIV_270 | VVI | n/a |
| DHUNIV_271 | VIA | n/a |
| DHUNIV_272 | IAI | n/a |
| DHUNIV_273 | HI | n/a |
| DHUNIV_274 | VI | n/a |
| DHUNIV_275 | IA | n/a |
| DHUNIV_276 | HIVVVTAIP | 3891 |
| DHUNIV_277 | HIVVVTAI | 3892 |
| DHUNIV_278 | IVVVTAIP | 3893 |
| DHUNIV_279 | HIVVVTA | 3894 |
| DHUNIV_280 | IVVVTAI | 3895 |
| DHUNIV_281 | VVVTAIP | 3896 |
| DHUNIV_282 | HIVVVT | 3897 |
| DHUNIV_283 | IVVVTA | 3898 |
| DHUNIV_284 | VVVTAI | 3899 |
| DHUNIV_285 | VVTAIP | 3900 |
| DHUNIV_286 | IVVVT | 3901 |
| DHUNIV_287 | VVVTA | 3902 |
| DHUNIV_288 | VVTAI | 3903 |
| DHUNIV_289 | VTAIP | 3904 |
| DHUNIV_290 | VVVT | 3905 |
| DHUNIV_291 | VVTA | 3906 |
| DHUNIV_292 | VTAI | 3907 |
| DHUNIV_293 | TAIP | 3908 |
| DHUNIV_294 | VVT | n/a |
| DHUNIV_295 | VTA | n/a |
| DHUNIV_296 | TAI | n/a |
| DHUNIV_297 | VT | n/a |
| DHUNIV_298 | TA | n/a |
| DHUNIV_299 | RILY | 3909 |
| DHUNIV_300 | ILY | n/a |
| DHUNIV_301 | MLY | n/a |
| DHUNIV_302 | ML | n/a |
| DHUNIV_303 | GYCTNGVCYT | 3910 |
| DHUNIV_304 | GYCTNGVCY | 3911 |
| DHUNIV_305 | YCTNGVCYT | 3912 |
| DHUNIV_306 | GYCTNGVC | 3913 |
| DHUNIV_307 | YCTNGVCY | 3914 |
| DHUNIV_308 | CTNGVCYT | 3915 |
| DHUNIV_309 | YCTNGVC | 3916 |
| DHUNIV_310 | CTNGVCY | 3917 |
| DHUNIV_311 | CTNGVC | 3918 |
| DHUNIV_312 | TNGV | 3919 |
| DHUNIV_313 | TNG | n/a |
| DHUNIV_314 | NGV | n/a |
| DHUNIV_315 | TN | n/a |
| DHUNIV_316 | NG | n/a |
| DHUNIV_317 | GV | n/a |
| DHUNIV_318 | DIVLMVYAIP | 3920 |
| DHUNIV_319 | DIVLMVYAI | 3921 |
| DHUNIV_320 | IVLMVYAIP | 3922 |
| DHUNIV_321 | DIVLMVYA | 3923 |
| DHUNIV_322 | IVLMVYAI | 3924 |
| DHUNIV_323 | VLMVYAIP | 3925 |
| DHUNIV_324 | DIVLMVY | 3926 |
| DHUNIV_325 | IVLMVYA | 3927 |
| DHUNIV_326 | VLMVYAI | 3928 |
| DHUNIV_327 | LMVYAIP | 3929 |
| DHUNIV_328 | DIVLMV | 3930 |
| DHUNIV_329 | IVLMVY | 3931 |
| DHUNIV_330 | VLMVYA | 3932 |
| DHUNIV_331 | LMVYAI | 3933 |
| DHUNIV_332 | MVYAIP | 3934 |
| DHUNIV_333 | DIVLM | 3935 |

TABLE 11-continued

1K DH Theoretical Segment Pool sequences (1,111 DH segments).

| DH Segment Name | Amino Acid Sequence | SEQ ID NO |
|---|---|---|
| DHUNIV_334 | IVLMV | 3936 |
| DHUNIV_335 | VLMVY | 3937 |
| DHUNIV_336 | LMVYA | 3938 |
| DHUNIV_337 | MVYAI | 3939 |
| DHUNIV_338 | VYAIP | 3940 |
| DHUNIV_339 | DIVL | 3941 |
| DHUNIV_340 | IVLM | 3942 |
| DHUNIV_341 | VLMV | 3943 |
| DHUNIV_342 | LMVY | 3944 |
| DHUNIV_343 | MVYA | 3945 |
| DHUNIV_344 | VYAI | 3946 |
| DHUNIV_345 | YAIP | 3947 |
| DHUNIV_346 | IVL | n/a |
| DHUNIV_347 | VLM | n/a |
| DHUNIV_348 | LMV | n/a |
| DHUNIV_349 | MVY | n/a |
| DHUNIV_350 | VYA | n/a |
| DHUNIV_351 | YAI | n/a |
| DHUNIV_352 | VL | n/a |
| DHUNIV_353 | LM | n/a |
| DHUNIV_354 | MV | n/a |
| DHUNIV_355 | VY | n/a |
| DHUNIV_356 | VLLWFGELL | 3948 |
| DHUNIV_357 | VLLWFGEL | 3949 |
| DHUNIV_358 | LLWFGELL | 3950 |
| DHUNIV_359 | VLLWFGE | 3951 |
| DHUNIV_360 | LLWFGEL | 3952 |
| DHUNIV_361 | LWFGELL | 3953 |
| DHUNIV_362 | VLLWFG | 3954 |
| DHUNIV_363 | LLWFGE | 3955 |
| DHUNIV_364 | LWFGEL | 3956 |
| DHUNIV_365 | WFGELL | 3957 |
| DHUNIV_366 | VLLWF | 3958 |
| DHUNIV_367 | LLWFG | 3959 |
| DHUNIV_368 | LWFGE | 3960 |
| DHUNIV_369 | WFGEL | 3961 |
| DHUNIV_370 | FGELL | 3962 |
| DHUNIV_371 | VLLW | 3963 |
| DHUNIV_372 | LLWF | 3964 |
| DHUNIV_373 | LWFG | 3965 |
| DHUNIV_374 | WFGE | 3966 |
| DHUNIV_375 | FGEL | 3967 |
| DHUNIV_376 | GELL | 3968 |
| DHUNIV_377 | VLL | n/a |
| DHUNIV_378 | LLW | n/a |
| DHUNIV_379 | LWF | n/a |
| DHUNIV_380 | WFG | n/a |
| DHUNIV_381 | FGE | n/a |
| DHUNIV_382 | GEL | n/a |
| DHUNIV_383 | WF | n/a |
| DHUNIV_384 | FG | n/a |
| DHUNIV_385 | GE | n/a |
| DHUNIV_386 | YYYGSGSYYN | 3969 |
| DHUNIV_387 | YYYGSGSYY | 3970 |
| DHUNIV_388 | YYGSGSYYN | 3971 |
| DHUNIV_389 | YYYGSGSY | 3972 |
| DHUNIV_390 | YYGSGSYY | 3973 |
| DHUNIV_391 | YGSGSYYN | 3974 |
| DHUNIV_392 | YYYGSGS | 3975 |
| DHUNIV_393 | YYGSGSY | 3976 |
| DHUNIV_394 | YGSGSYY | 3977 |
| DHUNIV_395 | GSGSYYN | 3978 |
| DHUNIV_396 | YYYGSG | 3979 |
| DHUNIV_397 | YYGSGS | 3980 |
| DHUNIV_398 | YGSGSY | 3981 |
| DHUNIV_399 | GSGSYY | 3982 |
| DHUNIV_400 | SGSYYN | 3983 |
| DHUNIV_401 | YYYGS | 3984 |
| DHUNIV_402 | YYGSG | 3985 |
| DHUNIV_403 | YGSGS | 3986 |
| DHUNIV_404 | GSGSY | 3987 |
| DHUNIV_405 | GSYYN | 3988 |
| DHUNIV_406 | YYYG | 3989 |
| DHUNIV_407 | YYGS | 3990 |

TABLE 11-continued

1K DH Theoretical Segment Pool sequences (1,111 DH segments).

| DH Segment Name | Amino Acid Sequence | SEQ ID NO |
|---|---|---|
| DHUNIV_408 | YGSG | 3991 |
| DHUNIV_409 | GSGS | 3992 |
| DHUNIV_410 | SYYN | 3993 |
| DHUNIV_411 | YYY | n/a |
| DHUNIV_412 | YYG | n/a |
| DHUNIV_413 | YGS | n/a |
| DHUNIV_414 | GSG | n/a |
| DHUNIV_415 | YYN | n/a |
| DHUNIV_416 | YG | n/a |
| DHUNIV_417 | ITMVRGVIIT | 3994 |
| DHUNIV_418 | ITMVRGVII | 3995 |
| DHUNIV_419 | TMVRGVIIT | 3996 |
| DHUNIV_420 | ITMVRGVI | 3997 |
| DHUNIV_421 | TMVRGVII | 3998 |
| DHUNIV_422 | MVRGVIIT | 3999 |
| DHUNIV_423 | ITMVRGV | 4000 |
| DHUNIV_424 | TMVRGVI | 4001 |
| DHUNIV_425 | MVRGVII | 4002 |
| DHUNIV_426 | VRGVIIT | 4003 |
| DHUNIV_427 | ITMVRG | 4004 |
| DHUNIV_428 | TMVRGV | 4005 |
| DHUNIV_429 | MVRGVI | 4006 |
| DHUNIV_430 | VRGVII | 4007 |
| DHUNIV_431 | RGVIIT | 4008 |
| DHUNIV_432 | ITMVR | 4009 |
| DHUNIV_433 | TMVRG | 4010 |
| DHUNIV_434 | MVRGV | 4011 |
| DHUNIV_435 | VRGVI | 4012 |
| DHUNIV_436 | RGVII | 4013 |
| DHUNIV_437 | GVIIT | 4014 |
| DHUNIV_438 | ITMV | 4015 |
| DHUNIV_439 | TMVR | 4016 |
| DHUNIV_440 | MVRG | 4017 |
| DHUNIV_441 | VRGV | 4018 |
| DHUNIV_442 | RGVI | 4019 |
| DHUNIV_443 | GVII | 4020 |
| DHUNIV_444 | VIIT | 4021 |
| DHUNIV_445 | ITM | n/a |
| DHUNIV_446 | TMV | n/a |
| DHUNIV_447 | MVR | n/a |
| DHUNIV_448 | VRG | n/a |
| DHUNIV_449 | RGV | n/a |
| DHUNIV_450 | GVI | n/a |
| DHUNIV_451 | VII | n/a |
| DHUNIV_452 | IIT | n/a |
| DHUNIV_453 | TM | n/a |
| DHUNIV_454 | VR | n/a |
| DHUNIV_455 | RG | n/a |
| DHUNIV_456 | II | n/a |
| DHUNIV_457 | VLLWFRELL | 4022 |
| DHUNIV_458 | VLLWFREL | 4023 |
| DHUNIV_459 | LLWFRELL | 4024 |
| DHUNIV_460 | VLLWFRE | 4025 |
| DHUNIV_461 | LLWFREL | 4026 |
| DHUNIV_462 | LWFRELL | 4027 |
| DHUNIV_463 | VLLWFR | 4028 |
| DHUNIV_464 | LLWFRE | 4029 |
| DHUNIV_465 | LWFREL | 4030 |
| DHUNIV_466 | WFRELL | 4031 |
| DHUNIV_467 | LLWFR | 4032 |
| DHUNIV_468 | LWFRE | 4033 |
| DHUNIV_469 | WFREL | 4034 |
| DHUNIV_470 | FRELL | 4035 |
| DHUNIV_471 | LWFR | 4036 |
| DHUNIV_472 | WFRE | 4037 |
| DHUNIV_473 | FREL | 4038 |
| DHUNIV_474 | RELL | 4039 |
| DHUNIV_475 | WFR | n/a |
| DHUNIV_476 | FRE | n/a |
| DHUNIV_477 | REL | n/a |
| DHUNIV_478 | FR | n/a |
| DHUNIV_479 | RE | n/a |
| DHUNIV_480 | ITMVQGVIIT | 4040 |
| DHUNIV_481 | ITMVQGVII | 4041 |

TABLE 11-continued

1K DH Theoretical Segment Pool sequences (1,111 DH segments).

| DH Segment Name | Amino Acid Sequence | SEQ ID NO |
|---|---|---|
| DHUNIV_482 | TMVQGVIIT | 4042 |
| DHUNIV_483 | ITMVQGVI | 4043 |
| DHUNIV_484 | TMVQGVII | 4044 |
| DHUNIV_485 | MVQGVIIT | 4045 |
| DHUNIV_486 | ITMVQGV | 4046 |
| DHUNIV_487 | TMVQGVI | 4047 |
| DHUNIV_488 | MVQGVII | 4048 |
| DHUNIV_489 | VQGVIIT | 4049 |
| DHUNIV_490 | ITMVQG | 4050 |
| DHUNIV_491 | TMVQGV | 4051 |
| DHUNIV_492 | MVQGVI | 4052 |
| DHUNIV_493 | VQGVII | 4053 |
| DHUNIV_494 | QGVIIT | 4054 |
| DHUNIV_495 | ITMVQ | 4055 |
| DHUNIV_496 | TMVQG | 4056 |
| DHUNIV_497 | MVQGV | 4057 |
| DHUNIV_498 | VQGVI | 4058 |
| DHUNIV_499 | QGVII | 4059 |
| DHUNIV_500 | TMVQ | 4060 |
| DHUNIV_501 | MVQG | 4061 |
| DHUNIV_502 | VQGV | 4062 |
| DHUNIV_503 | QGVI | 4063 |
| DHUNIV_504 | MVQ | n/a |
| DHUNIV_505 | VQG | n/a |
| DHUNIV_506 | QGV | n/a |
| DHUNIV_507 | QG | n/a |
| DHUNIV_508 | LRLGEL | 4064 |
| DHUNIV_509 | LRLGE | 4065 |
| DHUNIV_510 | RLGEL | 4066 |
| DHUNIV_511 | LRLG | 4067 |
| DHUNIV_512 | RLGE | 4068 |
| DHUNIV_513 | LGEL | 4069 |
| DHUNIV_514 | LRL | n/a |
| DHUNIV_515 | RLG | n/a |
| DHUNIV_516 | LGE | n/a |
| DHUNIV_517 | LR | n/a |
| DHUNIV_518 | RL | n/a |
| DHUNIV_519 | LG | n/a |
| DHUNIV_520 | YYDYVWGSYAYT | 4070 |
| DHUNIV_521 | YYDYVWGSYAY | 4071 |
| DHUNIV_522 | YDYVWGSYAYT | 4072 |
| DHUNIV_523 | YYDYVWGSYA | 4073 |
| DHUNIV_524 | YDYVWGSYAY | 4074 |
| DHUNIV_525 | DYVWGSYAYT | 4075 |
| DHUNIV_526 | YYDYVWGSY | 4076 |
| DHUNIV_527 | YDYVWGSYA | 4077 |
| DHUNIV_528 | DYVWGSYAY | 4078 |
| DHUNIV_529 | YVWGSYAYT | 4079 |
| DHUNIV_530 | YYDYVWGS | 4080 |
| DHUNIV_531 | YDYVWGSY | 4081 |
| DHUNIV_532 | DYVWGSYA | 4082 |
| DHUNIV_533 | YVWGSYAY | 4083 |
| DHUNIV_534 | VWGSYAYT | 4084 |
| DHUNIV_535 | YYDYVWG | 4085 |
| DHUNIV_536 | YDYVWGS | 4086 |
| DHUNIV_537 | DYVWGSY | 4087 |
| DHUNIV_538 | YVWGSYA | 4088 |
| DHUNIV_539 | VWGSYAY | 4089 |
| DHUNIV_540 | WGSYAYT | 4090 |
| DHUNIV_541 | YYDYVW | 4091 |
| DHUNIV_542 | YDYVWG | 4092 |
| DHUNIV_543 | DYVWGS | 4093 |
| DHUNIV_544 | YVWGSY | 4094 |
| DHUNIV_545 | VWGSYA | 4095 |
| DHUNIV_546 | WGSYAY | 4096 |
| DHUNIV_547 | GSYAYT | 4097 |
| DHUNIV_548 | YYDYV | 4098 |
| DHUNIV_549 | YDYVW | 4099 |
| DHUNIV_550 | DYVWG | 4100 |
| DHUNIV_551 | YVWGS | 4101 |
| DHUNIV_552 | VWGSY | 4102 |
| DHUNIV_553 | WGSYA | 4103 |
| DHUNIV_554 | GSYAY | 4104 |
| DHUNIV_555 | SYAYT | 4105 |

TABLE 11-continued

1K DH Theoretical Segment Pool sequences (1,111 DH segments).

| DH Segment Name | Amino Acid Sequence | SEQ ID NO |
|---|---|---|
| DHUNIV_556 | YYDY | 4106 |
| DHUNIV_557 | YDYV | 4107 |
| DHUNIV_558 | DYVW | 4108 |
| DHUNIV_559 | YVWG | 4109 |
| DHUNIV_560 | VWGS | 4110 |
| DHUNIV_561 | WGSY | 4111 |
| DHUNIV_562 | GSYA | 4112 |
| DHUNIV_563 | SYAY | 4113 |
| DHUNIV_564 | YAYT | 4114 |
| DHUNIV_565 | YYD | n/a |
| DHUNIV_566 | YDY | n/a |
| DHUNIV_567 | DYV | n/a |
| DHUNIV_568 | YVW | n/a |
| DHUNIV_569 | VWG | n/a |
| DHUNIV_570 | WGS | n/a |
| DHUNIV_571 | SYA | n/a |
| DHUNIV_572 | YAY | n/a |
| DHUNIV_573 | AYT | n/a |
| DHUNIV_574 | YD | n/a |
| DHUNIV_575 | DY | n/a |
| DHUNIV_576 | YV | n/a |
| DHUNIV_577 | VW | n/a |
| DHUNIV_578 | WG | n/a |
| DHUNIV_579 | IMITFGGVMLIP | 4115 |
| DHUNIV_580 | IMITFGGVMLI | 4116 |
| DHUNIV_581 | MITFGGVMLIP | 4117 |
| DHUNIV_582 | IMITFGGVML | 4118 |
| DHUNIV_583 | MITFGGVMLI | 4119 |
| DHUNIV_584 | ITFGGVMLIP | 4120 |
| DHUNIV_585 | IMITFGGVM | 4121 |
| DHUNIV_586 | MITFGGVML | 4122 |
| DHUNIV_587 | ITFGGVMLI | 4123 |
| DHUNIV_588 | TFGGVMLIP | 4124 |
| DHUNIV_589 | IMITFGGV | 4125 |
| DHUNIV_590 | MITFGGVM | 4126 |
| DHUNIV_591 | ITFGGVML | 4127 |
| DHUNIV_592 | TFGGVMLI | 4128 |
| DHUNIV_593 | FGGVMLIP | 4129 |
| DHUNIV_594 | IMITFGG | 4130 |
| DHUNIV_595 | MITFGGV | 4131 |
| DHUNIV_596 | ITFGGVM | 4132 |
| DHUNIV_597 | TFGGVML | 4133 |
| DHUNIV_598 | FGGVMLI | 4134 |
| DHUNIV_599 | GGVMLIP | 4135 |
| DHUNIV_600 | IMITFG | 4136 |
| DHUNIV_601 | MITFGG | 4137 |
| DHUNIV_602 | ITFGGV | 4138 |
| DHUNIV_603 | TFGGVM | 4139 |
| DHUNIV_604 | FGGVML | 4140 |
| DHUNIV_605 | GGVMLI | 4141 |
| DHUNIV_606 | GVMLIP | 4142 |
| DHUNIV_607 | IMITF | 4143 |
| DHUNIV_608 | MITFG | 4144 |
| DHUNIV_609 | ITFGG | 4145 |
| DHUNIV_610 | TFGGV | 4146 |
| DHUNIV_611 | FGGVM | 4147 |
| DHUNIV_612 | GGVML | 4148 |
| DHUNIV_613 | GVMLI | 4149 |
| DHUNIV_614 | VMLIP | 4150 |
| DHUNIV_615 | IMIT | 4151 |
| DHUNIV_616 | MITF | 4152 |
| DHUNIV_617 | ITFG | 4153 |
| DHUNIV_618 | TFGG | 4154 |
| DHUNIV_619 | FGGV | 4155 |
| DHUNIV_620 | GGVM | 4156 |
| DHUNIV_621 | GVML | 4157 |
| DHUNIV_622 | VMLI | 4158 |
| DHUNIV_623 | MLIP | 4159 |
| DHUNIV_624 | IMI | n/a |
| DHUNIV_625 | MIT | n/a |
| DHUNIV_626 | ITF | n/a |
| DHUNIV_627 | TFG | n/a |
| DHUNIV_628 | FGG | n/a |
| DHUNIV_629 | GGV | n/a |

TABLE 11-continued

1K DH Theoretical Segment Pool sequences (1,111 DH segments).

| DH Segment Name | Amino Acid Sequence | SEQ ID NO |
|---|---|---|
| DHUNIV_630 | GVM | n/a |
| DHUNIV_631 | VML | n/a |
| DHUNIV_632 | MLI | n/a |
| DHUNIV_633 | LIP | n/a |
| DHUNIV_634 | IM | n/a |
| DHUNIV_635 | MI | n/a |
| DHUNIV_636 | TF | n/a |
| DHUNIV_637 | VM | n/a |
| DHUNIV_638 | LI | n/a |
| DHUNIV_639 | WLLL | 4160 |
| DHUNIV_640 | WLL | n/a |
| DHUNIV_641 | WL | n/a |
| DHUNIV_642 | YYYDSSGYYY | 4161 |
| DHUNIV_643 | YYYDSSGYY | 4162 |
| DHUNIV_644 | YYDSSGYYY | 4163 |
| DHUNIV_645 | YYYDSSGY | 4164 |
| DHUNIV_646 | YYDSSGYY | 4165 |
| DHUNIV_647 | YDSSGYYY | 4166 |
| DHUNIV_648 | YYYDSSG | 4167 |
| DHUNIV_649 | YYDSSGY | 4168 |
| DHUNIV_650 | YDSSGYY | 4169 |
| DHUNIV_651 | DSSGYYY | 4170 |
| DHUNIV_652 | YYYDSS | 4171 |
| DHUNIV_653 | YYDSSG | 4172 |
| DHUNIV_654 | YDSSGY | 4173 |
| DHUNIV_655 | DSSGYY | 4174 |
| DHUNIV_656 | SSGYYY | 4175 |
| DHUNIV_657 | YYYDS | 4176 |
| DHUNIV_658 | YYDSS | 4177 |
| DHUNIV_659 | YDSSG | 4178 |
| DHUNIV_660 | DSSGY | 4179 |
| DHUNIV_661 | SSGYY | 4180 |
| DHUNIV_662 | SGYYY | 4181 |
| DHUNIV_663 | YYYD | 4182 |
| DHUNIV_664 | YYDS | 4183 |
| DHUNIV_665 | YDSS | 4184 |
| DHUNIV_666 | DSSG | 4185 |
| DHUNIV_667 | SSGY | 4186 |
| DHUNIV_668 | SGYY | 4187 |
| DHUNIV_669 | GYYY | 4188 |
| DHUNIV_670 | YDS | n/a |
| DHUNIV_671 | DSS | n/a |
| DHUNIV_672 | SSG | n/a |
| DHUNIV_673 | SGY | n/a |
| DHUNIV_674 | GYY | n/a |
| DHUNIV_675 | DS | n/a |
| DHUNIV_676 | ITMIVVVITT | 4189 |
| DHUNIV_677 | ITMIVVVIT | 4190 |
| DHUNIV_678 | TMIVVVITT | 4191 |
| DHUNIV_679 | ITMIVVVI | 4192 |
| DHUNIV_680 | TMIVVVIT | 4193 |
| DHUNIV_681 | MIVVVITT | 4194 |
| DHUNIV_682 | ITMIVVV | 4195 |
| DHUNIV_683 | TMIVVVI | 4196 |
| DHUNIV_684 | MIVVVIT | 4197 |
| DHUNIV_685 | IVVVITT | 4198 |
| DHUNIV_686 | ITMIVV | 4199 |
| DHUNIV_687 | TMIVVV | 4200 |
| DHUNIV_688 | MIVVVI | 4201 |
| DHUNIV_689 | IVVVIT | 4202 |
| DHUNIV_690 | VVVITT | 4203 |
| DHUNIV_691 | ITMIV | 4204 |
| DHUNIV_692 | TMIVV | 4205 |
| DHUNIV_693 | MIVVV | 4206 |
| DHUNIV_694 | VVVIT | 4207 |
| DHUNIV_695 | VVITT | 4208 |
| DHUNIV_696 | ITMI | 4209 |
| DHUNIV_697 | TMIV | 4210 |
| DHUNIV_698 | MIVV | 4211 |
| DHUNIV_699 | VVIT | 4212 |
| DHUNIV_700 | VITT | 4213 |
| DHUNIV_701 | TMI | n/a |
| DHUNIV_702 | MIV | n/a |
| DHUNIV_703 | VIT | n/a |

TABLE 11-continued

1K DH Theoretical Segment Pool sequences (1,111 DH segments).

| DH Segment Name | Amino Acid Sequence | SEQ ID NO |
|---|---|---|
| DHUNIV_704 | ITT | n/a |
| DHUNIV_705 | VLRFLEWLLY | 4214 |
| DHUNIV_706 | VLRFLEWLL | 4215 |
| DHUNIV_707 | LRFLEWLLY | 4216 |
| DHUNIV_708 | VLRFLEWL | 4217 |
| DHUNIV_709 | LRFLEWLL | 4218 |
| DHUNIV_710 | RFLEWLLY | 4219 |
| DHUNIV_711 | VLRFLEW | 4220 |
| DHUNIV_712 | LRFLEWL | 4221 |
| DHUNIV_713 | RFLEWLL | 4222 |
| DHUNIV_714 | FLEWLLY | 4223 |
| DHUNIV_715 | VLRFLE | 4224 |
| DHUNIV_716 | LRFLEW | 4225 |
| DHUNIV_717 | RFLEWL | 4226 |
| DHUNIV_718 | FLEWLL | 4227 |
| DHUNIV_719 | LEWLLY | 4228 |
| DHUNIV_720 | VLRFL | 4229 |
| DHUNIV_721 | LRFLE | 4230 |
| DHUNIV_722 | RFLEW | 4231 |
| DHUNIV_723 | FLEWL | 4232 |
| DHUNIV_724 | LEWLL | 4233 |
| DHUNIV_725 | EWLLY | 4234 |
| DHUNIV_726 | VLRF | 4235 |
| DHUNIV_727 | LRFL | 4236 |
| DHUNIV_728 | RFLE | 4237 |
| DHUNIV_729 | FLEW | 4238 |
| DHUNIV_730 | LEWL | 4239 |
| DHUNIV_731 | EWLL | 4240 |
| DHUNIV_732 | WLLY | 4241 |
| DHUNIV_733 | VLR | n/a |
| DHUNIV_734 | LRF | n/a |
| DHUNIV_735 | RFL | n/a |
| DHUNIV_736 | FLE | n/a |
| DHUNIV_737 | LEW | n/a |
| DHUNIV_738 | EWL | n/a |
| DHUNIV_739 | RF | n/a |
| DHUNIV_740 | FL | n/a |
| DHUNIV_741 | EW | n/a |
| DHUNIV_742 | YYDFWSGYYT | 4242 |
| DHUNIV_743 | YYDFWSGYY | 4243 |
| DHUNIV_744 | YDFWSGYYT | 4244 |
| DHUNIV_745 | YYDFWSGY | 4245 |
| DHUNIV_746 | YDFWSGYY | 4246 |
| DHUNIV_747 | DFWSGYYT | 4247 |
| DHUNIV_748 | YYDFWSG | 4248 |
| DHUNIV_749 | YDFWSGY | 4249 |
| DHUNIV_750 | DFWSGYY | 4250 |
| DHUNIV_751 | FWSGYYT | 4251 |
| DHUNIV_752 | YYDFWS | 4252 |
| DHUNIV_753 | YDFWSG | 4253 |
| DHUNIV_754 | DFWSGY | 4254 |
| DHUNIV_755 | FWSGYY | 4255 |
| DHUNIV_756 | WSGYYT | 4256 |
| DHUNIV_757 | YYDFW | 4257 |
| DHUNIV_758 | YDFWS | 4258 |
| DHUNIV_759 | DFWSG | 4259 |
| DHUNIV_760 | FWSGY | 4260 |
| DHUNIV_761 | WSGYY | 4261 |
| DHUNIV_762 | SGYYT | 4262 |
| DHUNIV_763 | YYDF | 4263 |
| DHUNIV_764 | YDFW | 4264 |
| DHUNIV_765 | DFWS | 4265 |
| DHUNIV_766 | FWSG | 4266 |
| DHUNIV_767 | WSGY | 4267 |
| DHUNIV_768 | GYYT | 4268 |
| DHUNIV_769 | YDF | n/a |
| DHUNIV_770 | DFW | n/a |
| DHUNIV_771 | FWS | n/a |
| DHUNIV_772 | WSG | n/a |
| DHUNIV_773 | YYT | n/a |
| DHUNIV_774 | DF | n/a |
| DHUNIV_775 | FW | n/a |
| DHUNIV_776 | WS | n/a |
| DHUNIV_777 | ITIFGVVIIP | 4269 |

TABLE 11-continued

1K DH Theoretical Segment Pool sequences (1,111 DH segments).

| DH Segment Name | Amino Acid Sequence | SEQ ID NO |
|---|---|---|
| DHUNIV_778 | ITIFGVVII | 4270 |
| DHUNIV_779 | TIFGVVIIP | 4271 |
| DHUNIV_780 | ITIFGVVI | 4272 |
| DHUNIV_781 | TIFGVVII | 4273 |
| DHUNIV_782 | IFGVVIIP | 4274 |
| DHUNIV_783 | ITIFGVV | 4275 |
| DHUNIV_784 | TIFGVVI | 4276 |
| DHUNIV_785 | IFGVVII | 4277 |
| DHUNIV_786 | FGVVIIP | 4278 |
| DHUNIV_787 | ITIFGV | 4279 |
| DHUNIV_788 | TIFGVV | 4280 |
| DHUNIV_789 | IFGVVI | 4281 |
| DHUNIV_790 | FGVVII | 4282 |
| DHUNIV_791 | GVVIIP | 4283 |
| DHUNIV_792 | ITIFG | 4284 |
| DHUNIV_793 | TIFGV | 4285 |
| DHUNIV_794 | IFGVV | 4286 |
| DHUNIV_795 | FGVVI | 4287 |
| DHUNIV_796 | GVVII | 4288 |
| DHUNIV_797 | VVIIP | 4289 |
| DHUNIV_798 | ITIF | 4290 |
| DHUNIV_799 | TIFG | 4291 |
| DHUNIV_800 | IFGV | 4292 |
| DHUNIV_801 | FGVV | 4293 |
| DHUNIV_802 | GVVI | 4294 |
| DHUNIV_803 | VVII | 4295 |
| DHUNIV_804 | VIIP | 4296 |
| DHUNIV_805 | ITI | n/a |
| DHUNIV_806 | TIF | n/a |
| DHUNIV_807 | IFG | n/a |
| DHUNIV_808 | FGV | n/a |
| DHUNIV_809 | GVV | n/a |
| DHUNIV_810 | IIP | n/a |
| DHUNIV_811 | TI | n/a |
| DHUNIV_812 | IF | n/a |
| DHUNIV_813 | VLRYFDWLL | 4297 |
| DHUNIV_814 | VLRYFDWL | 4298 |
| DHUNIV_815 | LRYFDWLL | 4299 |
| DHUNIV_816 | VLRYFDW | 4300 |
| DHUNIV_817 | LRYFDWL | 4301 |
| DHUNIV_818 | RYFDWLL | 4302 |
| DHUNIV_819 | VLRYFD | 4303 |
| DHUNIV_820 | LRYFDW | 4304 |
| DHUNIV_821 | RYFDWL | 4305 |
| DHUNIV_822 | YFDWLL | 4306 |
| DHUNIV_823 | VLRYF | 4307 |
| DHUNIV_824 | LRYFD | 4308 |
| DHUNIV_825 | RYFDW | 4309 |
| DHUNIV_826 | YFDWL | 4310 |
| DHUNIV_827 | FDWLL | 4311 |
| DHUNIV_828 | VLRY | 4312 |
| DHUNIV_829 | LRYF | 4313 |
| DHUNIV_830 | RYFD | 4314 |
| DHUNIV_831 | YFDW | 4315 |
| DHUNIV_832 | FDWL | 4316 |
| DHUNIV_833 | DWLL | 4317 |
| DHUNIV_834 | LRY | n/a |
| DHUNIV_835 | RYF | n/a |
| DHUNIV_836 | YFD | n/a |
| DHUNIV_837 | FDW | n/a |
| DHUNIV_838 | DWL | n/a |
| DHUNIV_839 | RY | n/a |
| DHUNIV_840 | YF | n/a |
| DHUNIV_841 | FD | n/a |
| DHUNIV_842 | DW | n/a |
| DHUNIV_843 | YYDILTGYYN | 4318 |
| DHUNIV_844 | YYDILTGYY | 4319 |
| DHUNIV_845 | YDILTGYYN | 4320 |
| DHUNIV_846 | YYDILTGY | 4321 |
| DHUNIV_847 | YDILTGYY | 4322 |
| DHUNIV_848 | DILTGYYN | 4323 |
| DHUNIV_849 | YYDILTG | 4324 |
| DHUNIV_850 | YDILTGY | 4325 |
| DHUNIV_851 | DILTGYY | 4326 |

TABLE 11-continued

1K DH Theoretical Segment Pool sequences (1,111 DH segments).

| DH Segment Name | Amino Acid Sequence | SEQ ID NO |
|---|---|---|
| DHUNIV_852 | ILTGYYN | 4327 |
| DHUNIV_853 | YYDILT | 4328 |
| DHUNIV_854 | YDILTG | 4329 |
| DHUNIV_855 | DILTGY | 4330 |
| DHUNIV_856 | ILTGYY | 4331 |
| DHUNIV_857 | LTGYYN | 4332 |
| DHUNIV_858 | YYDIL | 4333 |
| DHUNIV_859 | YDILT | 4334 |
| DHUNIV_860 | DILTG | 4335 |
| DHUNIV_861 | ILTGY | 4336 |
| DHUNIV_862 | LTGYY | 4337 |
| DHUNIV_863 | TGYYN | 4338 |
| DHUNIV_864 | YYDI | 4339 |
| DHUNIV_865 | YDIL | 4340 |
| DHUNIV_866 | DILT | 4341 |
| DHUNIV_867 | ILTG | 4342 |
| DHUNIV_868 | LTGY | 4343 |
| DHUNIV_869 | TGYY | 4344 |
| DHUNIV_870 | GYYN | 4345 |
| DHUNIV_871 | YDI | n/a |
| DHUNIV_872 | DIL | n/a |
| DHUNIV_873 | ILT | n/a |
| DHUNIV_874 | LTG | n/a |
| DHUNIV_875 | TGY | n/a |
| DHUNIV_876 | LT | n/a |
| DHUNIV_877 | LVIIT | 4346 |
| DHUNIV_878 | LVII | 4347 |
| DHUNIV_879 | LVI | n/a |
| DHUNIV_880 | LV | n/a |
| DHUNIV_881 | DYGDY | 4348 |
| DHUNIV_882 | DYGD | 4349 |
| DHUNIV_883 | YGDY | 4350 |
| DHUNIV_884 | DYG | n/a |
| DHUNIV_885 | YGD | n/a |
| DHUNIV_886 | GDY | n/a |
| DHUNIV_887 | TTVTT | 4351 |
| DHUNIV_888 | TTVT | 4352 |
| DHUNIV_889 | TVTT | 4353 |
| DHUNIV_890 | TTV | n/a |
| DHUNIV_891 | TVT | n/a |
| DHUNIV_892 | VTT | n/a |
| DHUNIV_893 | TV | n/a |
| DHUNIV_894 | LRW | n/a |
| DHUNIV_895 | RW | n/a |
| DHUNIV_896 | DYGGNS | 4354 |
| DHUNIV_897 | DYGGN | 4355 |
| DHUNIV_898 | YGGNS | 4356 |
| DHUNIV_899 | DYGG | 4357 |
| DHUNIV_900 | YGGN | 4358 |
| DHUNIV_901 | GGNS | 4359 |
| DHUNIV_902 | YGG | n/a |
| DHUNIV_903 | GGN | n/a |
| DHUNIV_904 | GNS | n/a |
| DHUNIV_905 | GN | n/a |
| DHUNIV_906 | NS | n/a |
| DHUNIV_907 | TTVVTP | 4360 |
| DHUNIV_908 | TTVVT | 4361 |
| DHUNIV_909 | TVVTP | 4362 |
| DHUNIV_910 | TTVV | 4363 |
| DHUNIV_911 | TVVT | 4364 |
| DHUNIV_912 | VVTP | 4365 |
| DHUNIV_913 | TVV | n/a |
| DHUNIV_914 | VTP | n/a |
| DHUNIV_915 | LQ | n/a |
| DHUNIV_916 | DYSNY | 4366 |
| DHUNIV_917 | DYSN | 4367 |
| DHUNIV_918 | YSNY | 4368 |
| DHUNIV_919 | DYS | n/a |
| DHUNIV_920 | YSN | n/a |
| DHUNIV_921 | SNY | n/a |
| DHUNIV_922 | SN | n/a |
| DHUNIV_923 | VDIVATIT | 4369 |
| DHUNIV_924 | VDIVATI | 4370 |
| DHUNIV_925 | DIVATIT | 4371 |

TABLE 11-continued

1K DH Theoretical Segment Pool sequences (1,111 DH segments).

| DH Segment Name | Amino Acid Sequence | SEQ ID NO |
|---|---|---|
| DHUNIV_926 | VDIVAT | 4372 |
| DHUNIV_927 | DIVATI | 4373 |
| DHUNIV_928 | IVATIT | 4374 |
| DHUNIV_929 | VDIVA | 4375 |
| DHUNIV_930 | DIVAT | 4376 |
| DHUNIV_931 | IVATI | 4377 |
| DHUNIV_932 | VATIT | 4378 |
| DHUNIV_933 | VDIV | 4379 |
| DHUNIV_934 | DIVA | 4380 |
| DHUNIV_935 | IVAT | 4381 |
| DHUNIV_936 | VATI | 4382 |
| DHUNIV_937 | ATIT | 4383 |
| DHUNIV_938 | VDI | n/a |
| DHUNIV_939 | IVA | n/a |
| DHUNIV_940 | VAT | n/a |
| DHUNIV_941 | ATI | n/a |
| DHUNIV_942 | TIT | n/a |
| DHUNIV_943 | VD | n/a |
| DHUNIV_944 | WLRL | 4384 |
| DHUNIV_945 | WLR | n/a |
| DHUNIV_946 | GYSGYDY | 4385 |
| DHUNIV_947 | GYSGYD | 4386 |
| DHUNIV_948 | YSGYDY | 4387 |
| DHUNIV_949 | GYSGY | 4388 |
| DHUNIV_950 | YSGYD | 4389 |
| DHUNIV_951 | SGYDY | 4390 |
| DHUNIV_952 | GYSG | 4391 |
| DHUNIV_953 | YSGY | 4392 |
| DHUNIV_954 | SGYD | 4393 |
| DHUNIV_955 | GYDY | 4394 |
| DHUNIV_956 | GYS | n/a |
| DHUNIV_957 | GYD | n/a |
| DHUNIV_958 | VEMATIT | 4395 |
| DHUNIV_959 | VEMATI | 4396 |
| DHUNIV_960 | EMATIT | 4397 |
| DHUNIV_961 | VEMAT | 4398 |
| DHUNIV_962 | EMATI | 4399 |
| DHUNIV_963 | MATIT | 4400 |
| DHUNIV_964 | VEMA | 4401 |
| DHUNIV_965 | EMAT | 4402 |
| DHUNIV_966 | MATI | 4403 |
| DHUNIV_967 | VEM | n/a |
| DHUNIV_968 | EMA | n/a |
| DHUNIV_969 | MAT | n/a |
| DHUNIV_970 | VE | n/a |
| DHUNIV_971 | EM | n/a |
| DHUNIV_972 | MA | n/a |
| DHUNIV_973 | RWLQL | 4404 |
| DHUNIV_974 | RWLQ | 4405 |
| DHUNIV_975 | WLQL | 4406 |
| DHUNIV_976 | RWL | n/a |
| DHUNIV_977 | WLQ | n/a |
| DHUNIV_978 | LQL | n/a |
| DHUNIV_979 | RDGYNY | 4407 |
| DHUNIV_980 | RDGYN | 4408 |
| DHUNIV_981 | DGYNY | 4409 |
| DHUNIV_982 | RDGY | 4410 |
| DHUNIV_983 | DGYN | 4411 |
| DHUNIV_984 | GYNY | 4412 |
| DHUNIV_985 | RDG | n/a |
| DHUNIV_986 | DGY | n/a |
| DHUNIV_987 | GYN | n/a |
| DHUNIV_988 | YNY | n/a |
| DHUNIV_989 | RD | n/a |
| DHUNIV_990 | DG | n/a |
| DHUNIV_991 | VDTAMVT | 4413 |
| DHUNIV_992 | VDTAMV | 4414 |
| DHUNIV_993 | DTAMVT | 4415 |
| DHUNIV_994 | VDTAM | 4416 |
| DHUNIV_995 | DTAMV | 4417 |
| DHUNIV_996 | TAMVT | 4418 |
| DHUNIV_997 | VDTA | 4419 |
| DHUNIV_998 | DTAM | 4420 |
| DHUNIV_999 | TAMV | 4421 |

TABLE 11-continued

1K DH Theoretical Segment Pool sequences (1,111 DH segments).

| DH Segment Name | Amino Acid Sequence | SEQ ID NO |
|---|---|---|
| DHUNIV_1000 | AMVT | 4422 |
| DHUNIV_1001 | VDT | n/a |
| DHUNIV_1002 | DTA | n/a |
| DHUNIV_1003 | TAM | n/a |
| DHUNIV_1004 | AMV | n/a |
| DHUNIV_1005 | MVT | n/a |
| DHUNIV_1006 | DT | n/a |
| DHUNIV_1007 | WIQLWL | 4423 |
| DHUNIV_1008 | WIQLW | 4424 |
| DHUNIV_1009 | IQLWL | 4425 |
| DHUNIV_1010 | WIQL | 4426 |
| DHUNIV_1011 | IQLW | 4427 |
| DHUNIV_1012 | QLWL | 4428 |
| DHUNIV_1013 | WIQ | n/a |
| DHUNIV_1014 | IQL | n/a |
| DHUNIV_1015 | QLW | n/a |
| DHUNIV_1016 | LWL | n/a |
| DHUNIV_1017 | IQ | n/a |
| DHUNIV_1018 | GYSYGY | 4429 |
| DHUNIV_1019 | GYSYG | 4430 |
| DHUNIV_1020 | YSYGY | 4431 |
| DHUNIV_1021 | GYSY | 4432 |
| DHUNIV_1022 | YSYG | 4433 |
| DHUNIV_1023 | SYGY | 4434 |
| DHUNIV_1024 | YSY | n/a |
| DHUNIV_1025 | SYG | n/a |
| DHUNIV_1026 | YGY | n/a |
| DHUNIV_1027 | GYSSSWY | 4435 |
| DHUNIV_1028 | GYSSSW | 4436 |
| DHUNIV_1029 | YSSSWY | 4437 |
| DHUNIV_1030 | GYSSS | 4438 |
| DHUNIV_1031 | YSSSW | 4439 |
| DHUNIV_1032 | SSSWY | 4440 |
| DHUNIV_1033 | GYSS | 4441 |
| DHUNIV_1034 | YSSS | 4442 |
| DHUNIV_1035 | SSSW | 4443 |
| DHUNIV_1036 | SSWY | 4444 |
| DHUNIV_1037 | YSS | n/a |
| DHUNIV_1038 | SSS | n/a |
| DHUNIV_1039 | SSW | n/a |
| DHUNIV_1040 | SWY | n/a |
| DHUNIV_1041 | SW | n/a |
| DHUNIV_1042 | WY | n/a |
| DHUNIV_1043 | GIAAAGT | 4445 |
| DHUNIV_1044 | GIAAAG | 4446 |
| DHUNIV_1045 | IAAAGT | 4447 |
| DHUNIV_1046 | GIAAA | 4448 |
| DHUNIV_1047 | IAAAG | 4449 |
| DHUNIV_1048 | AAAGT | 4450 |
| DHUNIV_1049 | GIAA | 4451 |
| DHUNIV_1050 | IAAA | 4452 |
| DHUNIV_1051 | AAAG | 4453 |
| DHUNIV_1052 | AAGT | 4454 |
| DHUNIV_1053 | GIA | n/a |
| DHUNIV_1054 | IAA | n/a |
| DHUNIV_1055 | AAA | n/a |
| DHUNIV_1056 | AAG | n/a |
| DHUNIV_1057 | AGT | n/a |
| DHUNIV_1058 | AG | n/a |
| DHUNIV_1059 | QQLV | 4455 |
| DHUNIV_1060 | QQL | n/a |
| DHUNIV_1061 | QLV | n/a |
| DHUNIV_1062 | QQ | n/a |
| DHUNIV_1063 | GYSSGWY | 4456 |
| DHUNIV_1064 | GYSSGW | 4457 |
| DHUNIV_1065 | YSSGWY | 4458 |
| DHUNIV_1066 | GYSSG | 4459 |
| DHUNIV_1067 | YSSGW | 4460 |
| DHUNIV_1068 | SSGWY | 4461 |
| DHUNIV_1069 | YSSG | 4462 |
| DHUNIV_1070 | SSGW | 4463 |
| DHUNIV_1071 | SGWY | 4464 |
| DHUNIV_1072 | SGW | n/a |
| DHUNIV_1073 | GWY | n/a |

TABLE 11-continued

1K DH Theoretical Segment Pool sequences (1,111 DH segments).

| DH Segment Name | Amino Acid Sequence | SEQ ID NO |
|---|---|---|
| DHUNIV_1074 | GW | n/a |
| DHUNIV_1075 | GIAVAGT | 4465 |
| DHUNIV_1076 | GIAVAG | 4466 |
| DHUNIV_1077 | IAVAGT | 4467 |
| DHUNIV_1078 | GIAVA | 4468 |
| DHUNIV_1079 | IAVAG | 4469 |
| DHUNIV_1080 | AVAGT | 4470 |
| DHUNIV_1081 | GIAV | 4471 |
| DHUNIV_1082 | IAVA | 4472 |
| DHUNIV_1083 | AVAG | 4473 |
| DHUNIV_1084 | VAGT | 4474 |
| DHUNIV_1085 | IAV | n/a |
| DHUNIV_1086 | AVA | n/a |
| DHUNIV_1087 | VAG | n/a |
| DHUNIV_1088 | AV | n/a |
| DHUNIV_1089 | QWLV | 4475 |
| DHUNIV_1090 | QWL | n/a |
| DHUNIV_1091 | WLV | n/a |
| DHUNIV_1092 | QW | n/a |
| DHUNIV_1093 | EYSSSS | 4476 |
| DHUNIV_1094 | EYSSS | 4477 |
| DHUNIV_1095 | YSSSS | 4478 |
| DHUNIV_1096 | EYSS | 4479 |
| DHUNIV_1097 | SSSS | 4480 |
| DHUNIV_1098 | EYS | n/a |
| DHUNIV_1099 | EY | n/a |
| DHUNIV_1100 | SIAARP | 4481 |
| DHUNIV_1101 | SIAAR | 4482 |
| DHUNIV_1102 | IAARP | 4483 |
| DHUNIV_1103 | SIAA | 4484 |
| DHUNIV_1104 | IAAR | 4485 |
| DHUNIV_1105 | AARP | 4486 |
| DHUNIV_1106 | SIA | n/a |
| DHUNIV_1107 | AAR | n/a |
| DHUNIV_1108 | ARP | n/a |
| DHUNIV_1109 | AR | n/a |
| DHUNIV_1110 | RP | n/a |
| DHUNIV_1111 | NWG | n/a |

TABLE 12

Theoretical segment pool of 141 N2 segments in Theoretical Segment Pool 1 (TSP1).

| Segment Type | Sequences | Number |
|---|---|---|
| "Zero" | (no addition) V segment joins directly to D segment | 1 |
| Monomers | G, P, R, A, S, L, T, V, D, E, F, H, I, K, M, Q, W, Y | 18 |
| Dimers | GG, GP, GR, GA, GS, GL, GT, GV, PG, RG, AG, SG, LG, TG, VG, PP, PR, PA, PS, PL, PT, PV, RP, AP, SP, LP, TP, VP, AR, AS, AT, AY, DL, DT, EA, EK, FH, FS, HL, HW, IS, KV, LD, LE, LR, LS, LT, NR, NT, QE, QL, QT, RA, RD, RE, RF, RH, RL, RR, RS, RV, SA, SD, SE, SF, SI, SK, SL, SQ, SR, SS, ST, SV, TA, TR, TS, TT, TW, VD, VS, WS, YS | 82 |
| Trimers | GGG, GPG, GRG, GAG, GSG, GLG, GTG, GVG, PGG, RGG, AGG, SGG, LGG, TGG, VGG, GGP, GGR, GGA, GGS, GGL, GGT, GGV, AAE, AYH, DTL, EKR, ISR, NTP, PKS, PRP, PTA, PTQ, REL, RPL, SAA, SAL, SGL, SSE, TGL, WGT | 40 |

TABLE 13

Theoretical segment pool of 285 H3-JH segments.

| H3-JH Segment Name | Amino Acid Sequence | SEQ ID NO |
|---|---|---|
| JHUNIV_001 | TEYFQH | 4487 |
| JHUNIV_002 | EYFQH | 4488 |
| JHUNIV_003 | YFQH | 4489 |
| JHUNIV_004 | FQH | n/a |
| JHUNIV_005 | QH | n/a |
| JHUNIV_006 | H | n/a |
| JHUNIV_007 |  | n/a |
| JHUNIV_008 | SEYFQH | 4490 |
| JHUNIV_009 | PEYFQH | 4491 |
| JHUNIV_010 | FEYFQH | 4492 |
| JHUNIV_011 | HEYFQH | 4493 |

TABLE 13-continued

Theoretical segment pool of 285 H3-JH segments.

| H3-JH Segment Name | Amino Acid Sequence | SEQ ID NO |
|---|---|---|
| JHUNIV_012 | REYFQH | 4494 |
| JHUNIV_013 | LEYFQH | 4495 |
| JHUNIV_014 | NEYFQH | 4496 |
| JHUNIV_015 | IEYFQH | 4497 |
| JHUNIV_016 | DEYFQH | 4498 |
| JHUNIV_017 | GEYFQH | 4499 |
| JHUNIV_018 | VEYFQH | 4500 |
| JHUNIV_019 | YEYFQH | 4501 |
| JHUNIV_020 | KYFQH | 4502 |
| JHUNIV_021 | QYFQH | 4503 |
| JHUNIV_022 | LYFQH | 4504 |
| JHUNIV_023 | SYFQH | 4505 |
| JHUNIV_024 | RYFQH | 4506 |
| JHUNIV_025 | PYFQH | 4507 |
| JHUNIV_026 | IYFQH | 4508 |
| JHUNIV_027 | TYFQH | 4509 |
| JHUNIV_028 | GYFQH | 4510 |
| JHUNIV_029 | VYFQH | 4511 |
| JHUNIV_030 | AYFQH | 4512 |
| JHUNIV_031 | NFQH | 4513 |
| JHUNIV_032 | DFQH | 4514 |
| JHUNIV_033 | HFQH | 4515 |
| JHUNIV_034 | FFQH | 4516 |
| JHUNIV_035 | SFQH | 4517 |
| JHUNIV_036 | RFQH | 4518 |
| JHUNIV_037 | LFQH | 4519 |
| JHUNIV_038 | PFQH | 4520 |
| JHUNIV_039 | IFQH | 4521 |
| JHUNIV_040 | TFQH | 4522 |
| JHUNIV_041 | GFQH | 4523 |
| JHUNIV_042 | VFQH | 4524 |
| JHUNIV_043 | AFQH | 4525 |
| JHUNIV_044 | AEYFQH | 4526 |
| JHUNIV_045 | YWYFDL | 4527 |
| JHUNIV_046 | WYFDL | 4528 |
| JHUNIV_047 | YFDL | 4529 |
| JHUNIV_048 | FDL | n/a |
| JHUNIV_049 | DL | n/a |
| JHUNIV_050 | L | n/a |
| JHUNIV_051 | DWYFDL | 4530 |
| JHUNIV_052 | HWYFDL | 4531 |
| JHUNIV_053 | NWYFDL | 4532 |
| JHUNIV_054 | GYFDL | 4533 |
| JHUNIV_055 | RYFDL | 4534 |
| JHUNIV_056 | HFDL | 4535 |
| JHUNIV_057 | NFDL | 4536 |
| JHUNIV_058 | DFDL | 4537 |
| JHUNIV_059 | DAFDI | 4538 |
| JHUNIV_060 | AFDI | 4539 |
| JHUNIV_061 | FDI | n/a |
| JHUNIV_062 | DI | n/a |
| JHUNIV_063 | I | n/a |
| JHUNIV_064 | YAFDI | 4540 |
| JHUNIV_065 | HAFDI | 4541 |
| JHUNIV_066 | FAFDI | 4542 |
| JHUNIV_067 | SAFDI | 4543 |
| JHUNIV_068 | RAFDI | 4544 |
| JHUNIV_069 | LAFDI | 4545 |
| JHUNIV_070 | PAFDI | 4546 |
| JHUNIV_071 | IAFDI | 4547 |
| JHUNIV_072 | TAFDI | 4548 |
| JHUNIV_073 | GAFDI | 4549 |
| JHUNIV_074 | VAFDI | 4550 |
| JHUNIV_075 | AAFDI | 4551 |
| JHUNIV_076 | TFDI | 4552 |
| JHUNIV_077 | SFDI | 4553 |
| JHUNIV_078 | PFDI | 4554 |
| JHUNIV_079 | FFDI | 4555 |
| JHUNIV_080 | HFDI | 4556 |
| JHUNIV_081 | RFDI | 4557 |
| JHUNIV_082 | LFDI | 4558 |
| JHUNIV_083 | NFDI | 4559 |
| JHUNIV_084 | IFDI | 4560 |
| JHUNIV_085 | DFDI | 4561 |

TABLE 13-continued

Theoretical segment pool of 285 H3-JH segments.

| H3-JH Segment Name | Amino Acid Sequence | SEQ ID NO |
|---|---|---|
| JHUNIV_086 | GFDI | 4562 |
| JHUNIV_087 | VFDI | 4563 |
| JHUNIV_088 | YFDI | 4564 |
| JHUNIV_089 | IDI | n/a |
| JHUNIV_090 | VDI | n/a |
| JHUNIV_091 | LDI | n/a |
| JHUNIV_092 | SDI | n/a |
| JHUNIV_093 | HDI | n/a |
| JHUNIV_094 | RDI | n/a |
| JHUNIV_095 | PDI | n/a |
| JHUNIV_096 | NDI | n/a |
| JHUNIV_097 | TDI | n/a |
| JHUNIV_098 | DDI | n/a |
| JHUNIV_099 | GDI | n/a |
| JHUNIV_100 | ADI | n/a |
| JHUNIV_101 | YDI | n/a |
| JHUNIV_102 | NAFDI | 4565 |
| JHUNIV_103 | DYFDY | 4566 |
| JHUNIV_104 | YFDY | 4567 |
| JHUNIV_105 | FDY | n/a |
| JHUNIV_106 | DY | n/a |
| JHUNIV_107 | Y | n/a |
| JHUNIV_108 | YYFDY | 4568 |
| JHUNIV_109 | HYFDY | 4569 |
| JHUNIV_110 | FYFDY | 4570 |
| JHUNIV_111 | SYFDY | 4571 |
| JHUNIV_112 | RYFDY | 4572 |
| JHUNIV_113 | LYFDY | 4573 |
| JHUNIV_114 | PYFDY | 4574 |
| JHUNIV_115 | IYFDY | 4575 |
| JHUNIV_116 | TYFDY | 4576 |
| JHUNIV_117 | GYFDY | 4577 |
| JHUNIV_118 | VYFDY | 4578 |
| JHUNIV_119 | AYFDY | 4579 |
| JHUNIV_120 | NFDY | 4580 |
| JHUNIV_121 | DFDY | 4581 |
| JHUNIV_122 | HFDY | 4582 |
| JHUNIV_123 | FFDY | 4583 |
| JHUNIV_124 | SFDY | 4584 |
| JHUNIV_125 | RFDY | 4585 |
| JHUNIV_126 | LFDY | 4586 |
| JHUNIV_127 | PFDY | 4587 |
| JHUNIV_128 | IFDY | 4588 |
| JHUNIV_129 | TFDY | 4589 |
| JHUNIV_130 | GFDY | 4590 |
| JHUNIV_131 | VFDY | 4591 |
| JHUNIV_132 | AFDY | 4592 |
| JHUNIV_133 | IDY | n/a |
| JHUNIV_134 | VDY | n/a |
| JHUNIV_135 | LDY | n/a |
| JHUNIV_136 | SDY | n/a |
| JHUNIV_137 | HDY | n/a |
| JHUNIV_138 | RDY | n/a |
| JHUNIV_139 | PDY | n/a |
| JHUNIV_140 | NDY | n/a |
| JHUNIV_141 | TDY | n/a |
| JHUNIV_142 | DDY | n/a |
| JHUNIV_143 | GDY | n/a |
| JHUNIV_144 | ADY | n/a |
| JHUNIV_145 | YDY | n/a |
| JHUNIV_146 | NYFDY | 4593 |
| JHUNIV_147 | DNWFDP | 4594 |
| JHUNIV_148 | NWFDP | 4595 |
| JHUNIV_149 | WFDP | 4596 |
| JHUNIV_150 | FDP | n/a |
| JHUNIV_151 | DP | n/a |
| JHUNIV_152 | P | n/a |
| JHUNIV_153 | YNWFDP | 4597 |
| JHUNIV_154 | HNWFDP | 4598 |
| JHUNIV_155 | FNWFDP | 4599 |
| JHUNIV_156 | SNWFDP | 4600 |
| JHUNIV_157 | RNWFDP | 4601 |
| JHUNIV_158 | LNWFDP | 4602 |
| JHUNIV_159 | PNWFDP | 4603 |

TABLE 13-continued

Theoretical segment pool of 285 H3-JH segments.

| H3-JH Segment Name | Amino Acid Sequence | SEQ ID NO |
|---|---|---|
| JHUNIV_160 | INWFDP | 4604 |
| JHUNIV_161 | TNWFDP | 4605 |
| JHUNIV_162 | GNWFDP | 4606 |
| JHUNIV_163 | VNWFDP | 4607 |
| JHUNIV_164 | ANWFDP | 4608 |
| JHUNIV_165 | DWFDP | 4609 |
| JHUNIV_166 | YWFDP | 4610 |
| JHUNIV_167 | HWFDP | 4611 |
| JHUNIV_168 | FWFDP | 4612 |
| JHUNIV_169 | SWFDP | 4613 |
| JHUNIV_170 | RWFDP | 4614 |
| JHUNIV_171 | LWFDP | 4615 |
| JHUNIV_172 | PWFDP | 4616 |
| JHUNIV_173 | IWFDP | 4617 |
| JHUNIV_174 | TWFDP | 4618 |
| JHUNIV_175 | GWFDP | 4619 |
| JHUNIV_176 | VWFDP | 4620 |
| JHUNIV_177 | AWFDP | 4621 |
| JHUNIV_178 | RFDP | 4622 |
| JHUNIV_179 | GFDP | 4623 |
| JHUNIV_180 | LFDP | 4624 |
| JHUNIV_181 | SFDP | 4625 |
| JHUNIV_182 | QFDP | 4626 |
| JHUNIV_183 | PFDP | 4627 |
| JHUNIV_184 | KFDP | 4628 |
| JHUNIV_185 | MFDP | 4629 |
| JHUNIV_186 | TFDP | 4630 |
| JHUNIV_187 | EFDP | 4631 |
| JHUNIV_188 | VFDP | 4632 |
| JHUNIV_189 | AFDP | 4633 |
| JHUNIV_190 | NNWFDP | 4634 |
| JHUNIV_191 | DYYYYYGMDV | 4635 |
| JHUNIV_192 | YYYYYGMDV | 4636 |
| JHUNIV_193 | YYYYGMDV | 4637 |
| JHUNIV_194 | YYYGMDV | 4638 |
| JHUNIV_195 | YYGMDV | 4639 |
| JHUNIV_196 | YGMDV | 4640 |
| JHUNIV_197 | GMDV | 4641 |
| JHUNIV_198 | MDV | n/a |
| JHUNIV_199 | DV | n/a |
| JHUNIV_200 | V | n/a |
| JHUNIV_201 | YYYYYYGMDV | 4642 |
| JHUNIV_202 | HYYYYYGMDV | 4643 |
| JHUNIV_203 | FYYYYYGMDV | 4644 |
| JHUNIV_204 | SYYYYYGMDV | 4645 |
| JHUNIV_205 | RYYYYYGMDV | 4646 |
| JHUNIV_206 | LYYYYYGMDV | 4647 |
| JHUNIV_207 | PYYYYYGMDV | 4648 |
| JHUNIV_208 | IYYYYYGMDV | 4649 |
| JHUNIV_209 | TYYYYYGMDV | 4650 |
| JHUNIV_210 | GYYYYYGMDV | 4651 |
| JHUNIV_211 | VYYYYYGMDV | 4652 |
| JHUNIV_212 | AYYYYYGMDV | 4653 |
| JHUNIV_213 | NYYYYGMDV | 4654 |
| JHUNIV_214 | DYYYYGMDV | 4655 |
| JHUNIV_215 | HYYYYGMDV | 4656 |
| JHUNIV_216 | FYYYYGMDV | 4657 |
| JHUNIV_217 | SYYYYGMDV | 4658 |
| JHUNIV_218 | RYYYYGMDV | 4659 |
| JHUNIV_219 | LYYYYGMDV | 4660 |
| JHUNIV_220 | PYYYYGMDV | 4661 |
| JHUNIV_221 | IYYYYGMDV | 4662 |
| JHUNIV_222 | TYYYYGMDV | 4663 |
| JHUNIV_223 | GYYYYGMDV | 4664 |
| JHUNIV_224 | VYYYYGMDV | 4665 |
| JHUNIV_225 | AYYYYGMDV | 4666 |
| JHUNIV_226 | NYYYGMDV | 4667 |
| JHUNIV_227 | DYYYGMDV | 4668 |
| JHUNIV_228 | HYYYGMDV | 4669 |
| JHUNIV_229 | FYYYGMDV | 4670 |
| JHUNIV_230 | SYYYGMDV | 4671 |
| JHUNIV_231 | RYYYGMDV | 4672 |
| JHUNIV_232 | LYYYGMDV | 4673 |
| JHUNIV_233 | PYYYGMDV | 4674 |

TABLE 13-continued

Theoretical segment pool of 285 H3-JH segments.

| H3-JH Segment Name | Amino Acid Sequence | SEQ ID NO |
|---|---|---|
| JHUNIV_234 | IYYYGMDV | 4675 |
| JHUNIV_235 | TYYYGMDV | 4676 |
| JHUNIV_236 | GYYYGMDV | 4677 |
| JHUNIV_237 | VYYYGMDV | 4678 |
| JHUNIV_238 | AYYYGMDV | 4679 |
| JHUNIV_239 | NYYYYYGMDV | 4680 |
| JHUNIV_240 | DYYYYYYMDV | 4681 |
| JHUNIV_241 | YYYYYYMDV | 4682 |
| JHUNIV_242 | YYYYYMDV | 4683 |
| JHUNIV_243 | YYYYMDV | 4684 |
| JHUNIV_244 | YYYMDV | 4685 |
| JHUNIV_245 | YYMDV | 4686 |
| JHUNIV_246 | YMDV | 4687 |
| JHUNIV_247 | YYYYYYYMDV | 4688 |
| JHUNIV_248 | HYYYYYYMDV | 4689 |
| JHUNIV_249 | FYYYYYYMDV | 4690 |
| JHUNIV_250 | SYYYYYYMDV | 4691 |
| JHUNIV_251 | RYYYYYYMDV | 4692 |
| JHUNIV_252 | LYYYYYYMDV | 4693 |
| JHUNIV_253 | PYYYYYYMDV | 4694 |
| JHUNIV_254 | IYYYYYYMDV | 4695 |
| JHUNIV_255 | TYYYYYYMDV | 4696 |
| JHUNIV_256 | GYYYYYYMDV | 4697 |
| JHUNIV_257 | VYYYYYYMDV | 4698 |
| JHUNIV_258 | AYYYYYYMDV | 4699 |
| JHUNIV_259 | NYYYYYMDV | 4700 |
| JHUNIV_260 | DYYYYYMDV | 4701 |
| JHUNIV_261 | HYYYYYMDV | 4702 |
| JHUNIV_262 | FYYYYYMDV | 4703 |
| JHUNIV_263 | SYYYYYMDV | 4704 |
| JHUNIV_264 | RYYYYYMDV | 4705 |
| JHUNIV_265 | LYYYYYMDV | 4706 |
| JHUNIV_266 | PYYYYYMDV | 4707 |
| JHUNIV_267 | IYYYYYMDV | 4708 |
| JHUNIV_268 | TYYYYYMDV | 4709 |
| JHUNIV_269 | GYYYYYMDV | 4710 |
| JHUNIV_270 | VYYYYYMDV | 4711 |
| JHUNIV_271 | AYYYYYMDV | 4712 |
| JHUNIV_272 | NYYYYMDV | 4713 |
| JHUNIV_273 | DYYYYMDV | 4714 |
| JHUNIV_274 | HYYYYMDV | 4715 |
| JHUNIV_275 | FYYYYMDV | 4716 |
| JHUNIV_276 | SYYYYMDV | 4717 |
| JHUNIV_277 | RYYYYMDV | 4718 |
| JHUNIV_278 | LYYYYMDV | 4719 |
| JHUNIV_279 | PYYYYMDV | 4720 |
| JHUNIV_280 | IYYYYMDV | 4721 |
| JHUNIV_281 | TYYYYMDV | 4722 |
| JHUNIV_282 | GYYYYMDV | 4723 |
| JHUNIV_283 | VYYYYMDV | 4724 |
| JHUNIV_284 | AYYYYMDV | 4725 |
| JHUNIV_285 | NYYYYYMDV | 4726 |

TABLE 14

Twelve germline IGHJ genes and alleles.

| IGHJ Gene | DNA Sequence | SEQ ID NO |
|---|---|---|
| IGHJ1-01 | GCTGAATACTTCCAGCACTGGGGCCAGGGCACCCTGGTCACCGTCTCCTCAG | 4727 |
| IGHJ2-01 | CTACTGGTACTTCGATCTCTGGGGCCGTGGCACCCTGGTCACTGTCTCCTCAG | 4728 |
| IGHJ3-01 | ATGCTTTTGATGTCTGGGGCCAAGGGACAATGGTCACCGTCTCTTCAG | 4729 |
| IGHJ3-02 | ATGCTTTTGATATCTGGGGCCAAGGGACAATGGTCACCGTCTCTTCAG | 4730 |
| IGHJ4-01 | ACTACTTTGACTACTGGGGCCAAGGAACCCTGGTCACCGTCTCCTCAG | 4731 |
| IGHJ4-02 | ACTACTTTGACTACTGGGGCCAGGGAACCCTGGTCACCGTCTCCTCAG | 4732 |
| IGHJ4-03 | GCTACTTTGACTACTGGGGCCAAGGGACCCTGGTCACCGTCTCCTCAG | 4733 |

TABLE 14-continued

Twelve germline IGHJ genes and alleles.

| IGHJ Gene | DNA Sequence | SEQ ID NO |
|---|---|---|
| IGHJ5-01 | ACAACTGGTTCGACTCCTGGGGCCAAGGAACCCTGGTCACCGTCTCCTCAG | 4734 |
| IGHJ5-02 | ACAACTGGTTCGACCCCTGGGGCCAGGGAACCCTGGTCACCGTCTCCTCAG | 4735 |
| IGHJ6-01 | ATTACTACTACTACGGTATGGACGTCTGGGGGCAAGGGACCACGGTCACCGTCTCCTCAG | 4736 |
| IGHJ6-02 | ATTACTACTACTACGGTATGGACGTCTGGGGCCAAGGGACCACGGTCACCGTCTCCTCAG | 4737 |
| IGHJ6-03 | ATTACTACTACTACTACATGGACGTCTGGGGCAAAGGGACCACGGTCACCGTCTCCTCAG | 4738 |

TABLE 15

Theoretical segment pool of 248 parent H3-JH segments.

| H3-JH Parent Segment Name | Amino Acid Sequence | SEQ ID NO |
|---|---|---|
| JHparent001 | ADI | n/a |
| JHparent002 | ADY | n/a |
| JHparent003 | DDI | n/a |
| JHparent004 | DDY | n/a |
| JHparent005 | GDI | n/a |
| JHparent006 | GDY | n/a |
| JHparent007 | HDI | n/a |
| JHparent008 | HDY | n/a |
| JHparent009 | IDI | n/a |
| JHparent010 | IDY | n/a |
| JHparent011 | LDI | n/a |
| JHparent012 | LDY | n/a |
| JHparent013 | NDI | n/a |
| JHparent014 | NDY | n/a |
| JHparent015 | PDI | n/a |
| JHparent016 | PDY | n/a |
| JHparent017 | RDI | n/a |
| JHparent018 | RDY | n/a |
| JHparent019 | SDI | n/a |
| JHparent020 | SDY | n/a |
| JHparent021 | TDI | n/a |
| JHparent022 | TDY | n/a |
| JHparent023 | VDI | n/a |
| JHparent024 | VDY | n/a |
| JHparent025 | YDI | n/a |
| JHparent026 | YDY | n/a |
| JHparent027 | AFDP | 4633 |
| JHparent028 | AFDY | 4592 |
| JHparent029 | AFQH | 4525 |
| JHparent030 | DFDI | 4561 |
| JHparent031 | DFDL | 4537 |
| JHparent032 | DFDY | 4581 |
| JHparent033 | DFQH | 4514 |
| JHparent034 | EFDP | 4631 |
| JHparent035 | FFDI | 4555 |
| JHparent036 | FFDY | 4583 |
| JHparent037 | FFQH | 4516 |
| JHparent038 | GFDI | 4562 |
| JHparent039 | GFDP | 4623 |
| JHparent040 | GFDY | 4590 |
| JHparent041 | GFQH | 4523 |
| JHparent042 | HFDI | 4556 |
| JHparent043 | HFDL | 4535 |
| JHparent044 | HFDY | 4582 |
| JHparent045 | HFQH | 4515 |
| JHparent046 | IFDI | 4560 |
| JHparent047 | IFDY | 4588 |
| JHparent048 | IFQH | 4521 |
| JHparent049 | KFDP | 4628 |

TABLE 15-continued

Theoretical segment pool of 248 parent H3-JH segments.

| H3-JH Parent Segment Name | Amino Acid Sequence | SEQ ID NO |
|---|---|---|
| JHparent050 | LFDI | 4558 |
| JHparent051 | LFDP | 4624 |
| JHparent052 | LFDY | 4586 |
| JHparent053 | LFQH | 4519 |
| JHparent054 | MFDP | 4629 |
| JHparent055 | NFDI | 4559 |
| JHparent056 | NFDL | 4536 |
| JHparent057 | NFDY | 4580 |
| JHparent058 | NFQH | 4513 |
| JHparent059 | PFDI | 4554 |
| JHparent060 | PFDP | 4627 |
| JHparent061 | PFDY | 4587 |
| JHparent062 | PFQH | 4520 |
| JHparent063 | QFDP | 4626 |
| JHparent064 | RFDI | 4557 |
| JHparent065 | RFDP | 4622 |
| JHparent066 | RFDY | 4585 |
| JHparent067 | RFQH | 4518 |
| JHparent068 | SFDI | 4553 |
| JHparent069 | SFDP | 4625 |
| JHparent070 | SFDY | 4584 |
| JHparent071 | SFQH | 4517 |
| JHparent072 | TFDI | 4552 |
| JHparent073 | TFDP | 4630 |
| JHparent074 | TFDY | 4589 |
| JHparent075 | TFQH | 4522 |
| JHparent076 | VFDI | 4563 |
| JHparent077 | VFDP | 4632 |
| JHparent078 | VFDY | 4591 |
| JHparent079 | VFQH | 4524 |
| JHparent080 | YFDI | 4564 |
| JHparent081 | YFDL | 4529 |
| JHparent082 | AAFDI | 4551 |
| JHparent083 | AWFDP | 4621 |
| JHparent084 | AYFDY | 4579 |
| JHparent085 | AYFQH | 4512 |
| JHparent086 | DAFDI | 4538 |
| JHparent087 | DWFDP | 4609 |
| JHparent088 | DYFDY | 4566 |
| JHparent089 | FAFDI | 4542 |
| JHparent090 | FWFDP | 4612 |
| JHparent091 | FYFDY | 4570 |
| JHparent092 | GAFDI | 4549 |
| JHparent093 | GWFDP | 4619 |
| JHparent094 | GYFDL | 4533 |
| JHparent095 | GYFDY | 4577 |
| JHparent096 | GYFQH | 4510 |
| JHparent097 | HAFDI | 4541 |
| JHparent098 | HWFDP | 4611 |
| JHparent099 | HYFDY | 4569 |
| JHparent100 | IAFDI | 4547 |
| JHparent101 | IWFDP | 4617 |
| JHparent102 | IYFDY | 4575 |
| JHparent103 | IYFQH | 4508 |
| JHparent104 | KYFQH | 4502 |
| JHparent105 | LAFDI | 4545 |
| JHparent106 | LWFDP | 4615 |
| JHparent107 | LYFDY | 4573 |
| JHparent108 | LYFQH | 4504 |
| JHparent109 | NAFDI | 4565 |
| JHparent110 | NYFDY | 4593 |
| JHparent111 | PAFDI | 4546 |
| JHparent112 | PWFDP | 4616 |
| JHparent113 | PYFDY | 4574 |
| JHparent114 | PYFQH | 4507 |
| JHparent115 | QYFQH | 4503 |
| JHparent116 | RAFDI | 4544 |
| JHparent117 | RWFDP | 4614 |
| JHparent118 | RYFDL | 4534 |
| JHparent119 | RYFDY | 4572 |
| JHparent120 | RYFQH | 4506 |
| JHparent121 | SAFDI | 4543 |

TABLE 15-continued

Theoretical segment pool of 248 parent H3-JH segments.

| H3-JH Parent Segment Name | Amino Acid Sequence | SEQ ID NO |
|---|---|---|
| JHparent122 | SWFDP | 4613 |
| JHparent123 | SYFDY | 4571 |
| JHparent124 | SYFQH | 4505 |
| JHparent125 | TAFDI | 4548 |
| JHparent126 | TWFDP | 4618 |
| JHparent127 | TYFDY | 4576 |
| JHparent128 | TYFQH | 4509 |
| JHparent129 | VAFDI | 4550 |
| JHparent130 | VWFDP | 4620 |
| JHparent131 | VYFDY | 4578 |
| JHparent132 | VYFQH | 4511 |
| JHparent133 | WYFDL | 4528 |
| JHparent134 | YAFDI | 4540 |
| JHparent135 | YWFDP | 4610 |
| JHparent136 | YYFDY | 4568 |
| JHparent137 | AEYFQH | 4526 |
| JHparent138 | ANWFDP | 4608 |
| JHparent139 | DEYFQH | 4498 |
| JHparent140 | DNWFDP | 4594 |
| JHparent141 | DWYFDL | 4530 |
| JHparent142 | FEYFQH | 4492 |
| JHparent143 | FNWFDP | 4599 |
| JHparent144 | GEYFQH | 4499 |
| JHparent145 | GNWFDP | 4606 |
| JHparent146 | HEYFQH | 4493 |
| JHparent147 | HNWFDP | 4598 |
| JHparent148 | HWYFDL | 4531 |
| JHparent149 | IEYFQH | 4497 |
| JHparent150 | INWFDP | 4604 |
| JHparent151 | LEYFQH | 4495 |
| JHparent152 | LNWFDP | 4602 |
| JHparent153 | NEYFQH | 4496 |
| JHparent154 | NNWFDP | 4634 |
| JHparent155 | NWYFDL | 4532 |
| JHparent156 | PEYFQH | 4491 |
| JHparent157 | PNWFDP | 4603 |
| JHparent158 | REYFQH | 4494 |
| JHparent159 | RNWFDP | 4601 |
| JHparent160 | SEYFQH | 4490 |
| JHparent161 | SNWFDP | 4600 |
| JHparent162 | TEYFQH | 4487 |
| JHparent163 | TNWFDP | 4605 |
| JHparent164 | VEYFQH | 4500 |
| JHparent165 | VNWFDP | 4607 |
| JHparent166 | YEYFQH | 4501 |
| JHparent167 | YNWFDP | 4597 |
| JHparent168 | YWYFDL | 4527 |
| JHparent169 | AYYYGMDV | 4679 |
| JHparent170 | AYYYYMDV | 4725 |
| JHparent171 | DYYYGMDV | 4668 |
| JHparent172 | DYYYYMDV | 4714 |
| JHparent173 | FYYYGMDV | 4670 |
| JHparent174 | FYYYYMDV | 4716 |
| JHparent175 | GYYYGMDV | 4677 |
| JHparent176 | GYYYYMDV | 4723 |
| JHparent177 | HYYYGMDV | 4669 |
| JHparent178 | HYYYYMDV | 4715 |
| JHparent179 | IYYYGMDV | 4675 |
| JHparent180 | IYYYYMDV | 4721 |
| JHparent181 | LYYYGMDV | 4673 |
| JHparent182 | LYYYYMDV | 4719 |
| JHparent183 | NYYYGMDV | 4667 |
| JHparent184 | NYYYYMDV | 4713 |
| JHparent185 | PYYYGMDV | 4674 |
| JHparent186 | PYYYYMDV | 4720 |
| JHparent187 | RYYYGMDV | 4672 |
| JHparent188 | RYYYYMDV | 4718 |
| JHparent189 | SYYYGMDV | 4671 |
| JHparent190 | SYYYYMDV | 4717 |
| JHparent191 | TYYYGMDV | 4676 |
| JHparent192 | TYYYYMDV | 4722 |
| JHparent193 | VYYYGMDV | 4678 |

TABLE 15-continued

Theoretical segment pool of 248 parent H3-JH segments.

| H3-JH Parent Segment Name | Amino Acid Sequence | SEQ ID NO |
|---|---|---|
| JHparent194 | VYYYYMDV | 4724 |
| JHparent195 | AYYYYGMDV | 4666 |
| JHparent196 | AYYYYYMDV | 4712 |
| JHparent197 | DYYYYGMDV | 4655 |
| JHparent198 | DYYYYYMDV | 4701 |
| JHparent199 | FYYYYGMDV | 4657 |
| JHparent200 | FYYYYYMDV | 4703 |
| JHparent201 | GYYYYGMDV | 4664 |
| JHparent202 | GYYYYYMDV | 4710 |
| JHparent203 | HYYYYGMDV | 4656 |
| JHparent204 | HYYYYYMDV | 4702 |
| JHparent205 | IYYYYGMDV | 4662 |
| JHparent206 | IYYYYYMDV | 4708 |
| JHparent207 | LYYYYGMDV | 4660 |
| JHparent208 | LYYYYYMDV | 4706 |
| JHparent209 | NYYYYGMDV | 4654 |
| JHparent210 | NYYYYYMDV | 4700 |
| JHparent211 | PYYYYGMDV | 4661 |
| JHparent212 | PYYYYYMDV | 4707 |
| JHparent213 | RYYYYGMDV | 4659 |
| JHparent214 | RYYYYYMDV | 4705 |
| JHparent215 | SYYYYGMDV | 4658 |
| JHparent216 | SYYYYYMDV | 4704 |
| JHparent217 | TYYYYGMDV | 4663 |
| JHparent218 | TYYYYYMDV | 4709 |
| JHparent219 | VYYYYGMDV | 4665 |
| JHparent220 | VYYYYYMDV | 4711 |
| JHparent221 | AYYYYYGMDV | 4653 |
| JHparent222 | AYYYYYYMDV | 4699 |
| JHparent223 | DYYYYYGMDV | 4635 |
| JHparent224 | DYYYYYYMDV | 4681 |
| JHparent225 | FYYYYYGMDV | 4644 |
| JHparent226 | FYYYYYYMDV | 4690 |
| JHparent227 | GYYYYYGMDV | 4651 |
| JHparent228 | GYYYYYYMDV | 4697 |
| JHparent229 | HYYYYYGMDV | 4643 |
| JHparent230 | HYYYYYYMDV | 4689 |
| JHparent231 | IYYYYYGMDV | 4649 |
| JHparent232 | IYYYYYYMDV | 4695 |
| JHparent233 | LYYYYYGMDV | 4647 |
| JHparent234 | LYYYYYYMDV | 4693 |
| JHparent235 | NYYYYYGMDV | 4680 |
| JHparent236 | NYYYYYYMDV | 4726 |
| JHparent237 | PYYYYYGMDV | 4648 |
| JHparent238 | PYYYYYYMDV | 4694 |
| JHparent239 | RYYYYYGMDV | 4646 |
| JHparent240 | RYYYYYYMDV | 4692 |
| JHparent241 | SYYYYYGMDV | 4645 |
| JHparent242 | SYYYYYYMDV | 4691 |
| JHparent243 | TYYYYYGMDV | 4650 |
| JHparent244 | TYYYYYYMDV | 4696 |
| JHparent245 | VYYYYYGMDV | 4652 |
| JHparent246 | VYYYYYYMDV | 4698 |
| JHparent247 | YYYYYYGMDV | 4642 |
| JHparent248 | YYYYYYYMDV | 4688 |

TABLE 16

Polynucleotide sequences of 27 human IGHD genes and alleles.

| IGHD Gene | Polynucleotide Sequence | SEQ ID NO |
|---|---|---|
| IGHD1-(1)-01 | GGTACAACTGGAACGAC | 4739 |
| IGHD1-20 | GGTATAACTGGAACGAC | 4740 |
| IGHD1-26 | GGTATAGTGGGAGCTACTAC | 4741 |
| IGHD1-7 | GGTATAACTGGAACTAC | 4742 |

TABLE 16-continued

Polynucleotide sequences of 27 human IGHD genes and alleles.

| IGHD Gene | Polynucleotide Sequence | SEQ ID NO |
|---|---|---|
| IGHD2-15-01 | AGGATATTGTAGTGGTGGTAGCTGCTACTCC | 4743 |
| IGHD2-2-x | AGGATATTGTAGTAGTACCAGCTGCTATGCC | 4744 |
| IGHD2-2-y | AGGATATTGTAGTAGTACCAGCTGCTATACC | 4745 |
| IGHD2-2-z | TGGATATTGTAGTAGTACCAGCTGCTATGCC | 4746 |
| IGHD2-21-01 | AGCATATTGTGGTGGTGATTGCTATTCC | 4747 |
| IGHD2-21-02 | AGCATATTGTGGTGGTGACTGCTATTCC | 4748 |
| IGHD2-8-01 | AGGATATTGTACTAATGGTGTATGCTATACC | 4749 |
| IGHD3-10-01 | GTATTACTATGGTTCGGGGAGTTATTATAAC | 4750 |
| IGHD3-10-03 | GTATTACTATGGTTCAGGGAGTTATTATAAC | 4751 |
| IGHD3-16-02 | GTATTATGATTACGTTTGGGGGAGTTATGCTTATACC | 4752 |
| IGHD3-22-01 | GTATTACTATGATAGTAGTGGTTATTACTAC | 4753 |
| IGHD3-3-01 | GTATTACGATTTTTGGAGTGGTTATTATACC | 4754 |
| IGHD3-9-01 | GTATTACGATATTTTGACTGGTTATTATAAC | 4755 |
| IGHD4-17 | TGACTACGGTGACTAC | 4756 |
| IGHD4-23-01 | TGACTACGGTGGTAACTCC | 4757 |
| IGHD4-4/11-01 | TGACTACAGTAACTAC | 4758 |
| IGHD5-12-01 | GTGGATATAGTGGCTACGATTAC | 4759 |
| IGHD5-24-01 | GTAGAGATGGCTACAATTAC | 4760 |
| IGHD5-5/18-01 | GTGGATACAGCTATGGTTAC | 4761 |
| IGHD6-13-01 | GGGTATAGCAGCAGCTGGTAC | 4762 |
| IGHD6-19-01 | GGGTATAGCAGTGGCTGGTAC | 4763 |
| IGHD6-6-01 | GAGTATAGCAGCTCGTCC | 4764 |
| IGHD7-27-01 | CTAACTGGGGA | 4765 |

TABLE 17

Theoretical segment pool of 73 DH parent Segments. "Z" represents a stop codon.

DH Parent

| Segment Name | Amino Acid Sequence | SEQ ID NO |
|---|---|---|
| DHparent001 | LTG | n/a |
| DHparent002 | NWG | n/a |
| DHparent003 | ZLG | n/a |
| DHparent004 | DYGDY | 4348 |
| DHparent005 | DYSNY | 4366 |
| DHparent006 | TTVTT | 4351 |
| DHparent007 | VQLER | 3737 |
| DHparent008 | VZLEL | 4766 |
| DHparent009 | VZLER | 4767 |
| DHparent010 | VZQLV | 4768 |
| DHparent011 | YNWND | 3740 |
| DHparent012 | YNWNY | 3765 |
| DHparent013 | ZLQZL | 4769 |
| DHparent014 | ZLRZL | 4770 |

TABLE 17-continued

Theoretical segment pool of 73 DH parent Segments. "Z" represents a stop codon.

DH Parent

| Segment Name | Amino Acid Sequence | SEQ ID NO |
|---|---|---|
| DHparent015 | DYGGNS | 4354 |
| DHparent016 | EYSSSS | 4476 |
| DHparent017 | GITGTT | 3743 |
| DHparent018 | GTTGTT | 3731 |
| DHparent019 | GYSYGY | 4429 |
| DHparent020 | RDGYNY | 4407 |
| DHparent021 | SIAARP | 4481 |
| DHparent022 | TTVVTP | 4360 |
| DHparent023 | VZQQLV | 4771 |
| DHparent024 | VZQWLV | 4772 |
| DHparent025 | VZWELL | 4773 |
| DHparent026 | WIQLWL | 4423 |
| DHparent027 | YSGSYY | 3759 |
| DHparent028 | ZLRWZL | 4774 |
| DHparent029 | ZRWLQL | 4775 |
| DHparent030 | GIAAAGT | 4445 |
| DHparent031 | GIAVAGT | 4465 |
| DHparent032 | GIVGATT | 3748 |
| DHparent033 | GYSGYDY | 4385 |
| DHparent034 | GYSSGWY | 4456 |
| DHparent035 | GYSSSWY | 4435 |
| DHparent036 | VDTAMVT | 4413 |
| DHparent037 | VEMATIT | 4395 |
| DHparent038 | WIZWLRL | 4776 |
| DHparent039 | VDIVATIT | 4369 |
| DHparent040 | AYCGGDCYS | 3862 |
| DHparent041 | HIVVVIAIP | 3871 |
| DHparent042 | HIVVVTAIP | 3891 |
| DHparent043 | SILWWZLLF | 4777 |
| DHparent044 | DIVLMVYAIP | 3920 |
| DHparent045 | DIVVVPAAIP | 3846 |
| DHparent046 | DIVVVPAAMP | 3816 |
| DHparent047 | DIVVVAATP | 3777 |
| DHparent048 | GYCSGGSCYS | 3767 |
| DHparent049 | GYCSSTSCYA | 3806 |
| DHparent050 | GYCSSTSCYT | 3843 |
| DHparent051 | GYCTNGVCYT | 3910 |
| DHparent052 | ITIFGVVIIP | 4269 |
| DHparent053 | ITIFZLVIIT | 4778 & 8746 |
| DHparent054 | ITMIVVITT | 4189 |
| DHparent055 | ITMVQGVIIT | 4040 |
| DHparent056 | ITMVRGVIIT | 3994 |
| DHparent057 | RILYZWCMLY | 4779 & 8747 |
| DHparent058 | RILZWWZLLL | 4780 |
| DHparent059 | RILZZYQLLC | 4781 |
| DHparent060 | RILZZYQLLY | 4782 |
| DHparent061 | VLLWFGELLZ | 4783 |
| DHparent062 | VLLWFRELLZ | 4784 |
| DHparent063 | VLLZZZWLLL | 4785 |
| DHparent064 | VLRFLEWLLY | 4214 |
| DHparent065 | VLRYFDWLLZ | 4786 |
| DHparent066 | WILZZYQLLC | 4787 |
| DHparent067 | YYDFWSGYYT | 4242 |
| DHparent068 | YYDILTGYYN | 4318 |
| DHparent069 | YYYDSSGYYY | 4161 |
| DHparent070 | YYYGSGSYYN | 3969 |
| DHparent071 | IMITFGGVMLIP | 4115 |
| DHparent072 | VLZLRLGELCLY | 4788 |
| DHparent073 | YYDYVWGSYAYT | 4070 |

TABLE 18

Application of Equation 1 to Test Case 1.

| Type | Segment | Weight |
|---|---|---|
| TN1 | R | 1.0 |
| DH | TA | 1.0 |
| N2 | H | 1.0 |
| H3-JH | HFDY (SEQ ID NO: 4582) | 1.0 |

TABLE 19

Application of Equation 1 to Test Cases 2.1 and 2.1.

| Type | Segment | Weight |
|---|---|---|
| TN1 | V and VG | 0.5 each |
| DH | GIVGA (SEQ ID NO: 3751) and IVGA (SEQ ID NO: 3755) | 0.5 each |
| N2 | AS | 1.0 |
| H3-JH | Y | 1.0 |

TABLE 20

Application of Equation 1 to Test Case 3.1.

| Type | Segment | Weight |
|---|---|---|
| TN1 | DR | 1.0 |
| DH | YSGYD (SEQ ID NO: 4389) | 0.8 |
| N2 | LG | 1.0 |
| H3-JH | Y | 1.0 |

TABLE 21

Application of Equation 1 to Test Cases 4.1 and 4.2.

| Type | Segment | Weight |
|---|---|---|
| TN1 | "—" and G | 0.5 each |
| DH | GIAAA (SEQ ID NO: 4448) and IAAA (SEQ ID NO: 4452) | 0.5 each |
| N2 | D | 1.0 |
| H3-JH | SNWFDP (SEQ ID NO: 4600) | 0.83 |

TABLE 22

Application of Equation 1 to all Test Cases.

| Type | Segments | Weight |
|---|---|---|
| TN1 | DR, R, VG, V, G and "—" | 0.25, 0.25, 0.125, 0.125, 0.125 and 0.125 respectively |
| DH | TA, YSGYD (SEQ ID NO: 4389), IAAA (SEQ ID NO: 4452), GIAAA (SEQ ID NO: 4448), IVGA (SEQ ID NO: 3755) and GIVGA (SEQ ID NO: 3751) | 0.25, 0.20, 0.125, 0.125, 0.125 and 0.125 respectively |
| N2 | AS, H, D and LG | 0.25 each |
| H3-JH | Y, HFDY and SNWFDP | 0.50, 0.25 and 0.209 |

TABLE 23

Segments used in Exemplary Library Design 1 (ELD-1). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 1 | — | n/a | YYYDSSGYY | 4162 | — | DAFDI | 4538 |
| 2 | G | n/a | YGDY | 4350 | Y | YYFDY | 4568 |
| 3 | D | n/a | DYGDY | 4348 | G | Y | n/a |
| 4 | A | n/a | YYYDSSGY | 4164 | D | FDY | n/a |
| 5 | V | n/a | YCSSTSCY | 3810 | S | DY | n/a |
| 6 | DR | n/a | YYDSSGY | 4168 | P | YGMDV | 4640 |
| 7 | S | n/a | YCSGGSCY | 3771 | F | — | n/a |
| 8 | L | n/a | YCSSTSC | 3812 | L | LDY | n/a |
| 9 | DL | n/a | GG | n/a | A | GAFDI | 4549 |
| 10 | R | n/a | RG | n/a | E | YFDY | 4567 |
| 11 | GR | n/a | SGSY | 3763 | V | YYGMDV | 4639 |
| 12 | T | n/a | YYDSSGYY | 4165 | H | AFDI | 4539 |
| 13 | GG | n/a | SS | n/a | T | PFDY | 4587 |
| 14 | E | n/a | YDFWSGY | 4249 | R | GMDV | 4641 |
| 15 | DS | n/a | GYCSSTSC | 3809 | W | GWFDP | 4619 |
| 16 | VG | n/a | DY | n/a | SG | YYYYGMDV | 4637 |
| 17 | DG | n/a | YYYDSSG | 4167 | I | IDY | n/a |
| 18 | AP | n/a | CSSTSCY | 3813 | RG | GYFDY | 4577 |
| 19 | GL | n/a | YYDFWSGY | 4245 | K | GFDY | 4590 |
| 20 | GS | n/a | SSGWY | 4461 | LG | MDV | n/a |
| 21 | DRG | n/a | AG | n/a | Q | VDY | n/a |
| 22 | DLG | n/a | DSSGY | 4179 | GP | YYYGMDV | 4638 |

TABLE 23-continued

Segments used in Exemplary Library Design 1 (ELD-1). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 23 | VP | n/a | SSSW | 4443 | PG | NWFDP | 4595 |
| 24 | DP | n/a | VGAT | 3756 | LP | PDY | n/a |
| 25 | P | n/a | SY | n/a | AG | WFDP | 4596 |
| 26 | EG | n/a | DTAM | 4420 | GS | NFDY | 4580 |
| 27 | GA | n/a | IAAAG | 4449 | TS | YWYFDL | 4527 |
| 28 | AG | n/a | YSSSW | 4439 | SS | NAFDI | 4565 |
| 29 | GV | n/a | GS | n/a | GG | HFDY | 4582 |
| 30 | GP | n/a | YYDSSG | 4172 | YS | SFDY | 4584 |
| 31 | ER | n/a | VG | n/a | M | YYYYYGMDV | 4636 |
| 32 | DV | n/a | YSSSWY | 4437 | SL | DYYYGMDV | 4668 |
| 33 | VGG | n/a | YCSGGSC | 3773 | SP | DFDY | 4581 |
| 34 | SG | n/a | YDSSGYY | 4169 | SD | YNWFDP | 4597 |
| 35 | GRG | n/a | GI | n/a | AP | DYYYYGMDV | 4655 |
| 36 | DA | n/a | GYCSGGSCY | 3768 | GR | YYYMDV | 4685 |
| 37 | DRP | n/a | YSSS | 4442 | TG | LFDY | 4586 |
| 38 | DSG | n/a | SSGW | 4463 | SR | DYFDY | 4566 |
| 39 | GPR | n/a | TA | n/a | LD | NYYYYGMDV | 4654 |
| 40 | DT | n/a | DSSGYY | 4174 | LS | GDY | n/a |
| 41 | GGG | n/a | GYCSSTSCY | 3807 | GA | YDY | n/a |
| 42 | DRGG | 3720 | TTVT | 4352 | VG | SYFDY | 4571 |
| 43 | PL | n/a | YSSGWY | 4458 | PP | YYMDV | 4686 |
| 44 | DPS | n/a | GW | n/a | RR | TFDY | 4589 |
| 45 | LP | n/a | LG | n/a | GSG | YYYYYYGMDV | 4642 |
| 46 | RG | n/a | DYGD | 4349 | GT | FFDY | 4583 |
| 47 | GT | n/a | TVTT | 4353 | TP | SYYYYGMDV | 4658 |
| 48 | LG | n/a | AAA | n/a | RP | VFDY | 4591 |
| 49 | DLP | n/a | YSSGW | 4460 | RD | YAFDI | 4540 |
| 50 | DGR | n/a | LV | n/a | QL | SDY | n/a |
| 51 | ERG | n/a | YYDFWSGYY | 4243 | TT | WYFDL | 4528 |
| 52 | DGS | n/a | YYDSSGYYY | 4163 | PL | DWFDP | 4609 |
| 53 | ES | n/a | YYDFWSG | 4248 | RS | AFDY | 4592 |
| 54 | PS | n/a | YGD | n/a | WS | PYYYYGMDV | 4661 |
| 55 | GGS | n/a | YG | n/a | RV | HYFDY | 4569 |
| 56 | DPR | n/a | GT | n/a | RF | DV | n/a |
| 57 | EA | n/a | YSGSY | 3760 | SF | RFDY | 4585 |
| 58 | GGR | n/a | YYYGSGSY | 3972 | PT | NYFDY | 4593 |

TABLE 23-continued

Segments used in Exemplary Library Design 1 (ELD-1).
The sequences collectively form a theoretical segment
pool that comprises individual theoretical segment
pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 59 | DGG | n/a | LR | n/a | PS | IFDY | 4588 |
| 60 | SP | n/a | SSS | n/a | AT | ADY | n/a |
| 61 | DPG | n/a | GD | n/a | RL | HYYYGMDV | 4669 |
| 62 | DSGG | 3723 | CSGGSCY | 3774 | SV | GYYYYYGMDV | 4651 |
| 63 | DPL | n/a | GY | n/a | RA | DWYFDL | 4530 |
| 64 | TP | n/a | YCGGDCY | 3866 | GRG | GYYYGMDV | 4677 |
| 65 | AGG | n/a | QWLV | 4475 | VP | YYYYMDV | 4684 |
| 66 | PR | n/a | IAAA | 4452 | SQ | V | n/a |
| 67 | DGT | n/a | QG | n/a | AS | FDP | n/a |
| 68 | GLG | n/a | YCSSTSCYT | 3844 | PR | DDY | n/a |
| 69 | DSP | n/a | SG | n/a | VD | GYYYYGMDV | 4664 |
| 70 | GGV | n/a | TTVTT | 4351 | GV | YMDV | 4687 |
| 71 | GPS | n/a | QQL | n/a | LT | NWYFDL | 4532 |
| 72 | GVG | n/a | IAVA | 4472 | TR | PYFDY | 4574 |
| 73 | GGA | n/a | GDY | n/a | VS | FDI | n/a |
| 74 | RP | n/a | YYYDSSGYYY | 4161 | SGL | NDY | n/a |
| 75 | DPP | n/a | DGYN | 4411 | RGG | HYYYYYGMDV | 4643 |
| 76 | DPT | n/a | CSSTSC | 3814 | LR | VYYYGMDV | 4678 |
| 77 | EV | n/a | IVVVPAAI | 3849 | SGG | VYFDY | 4578 |
| 78 | GAP | n/a | AVAG | 4473 | SA | SNWFDP | 4600 |
| 79 | DGRG | 3702 | AA | n/a | AY | NYYYGMDV | 4667 |
| 80 | GPP | n/a | DSSG | 4185 | LE | LYYYYGMDV | 4660 |
| 81 | DLGG | 3714 | VR | n/a | TGG | DYYYYYGMDV | 4635 |
| 82 | ET | n/a | YDFWSG | 4253 | GL | AAFDI | 4551 |
| 83 | DGGP | 3681 | GYSSSWY | 4435 | GAG | SWFDP | 4613 |
| 84 | DGGR | 3684 | SGW | n/a | TA | SYYYYYGMDV | 4645 |
| 85 | DGSG | 3705 | WG | n/a | IS | SYYYGMDV | 4671 |
| 86 | GTG | n/a | SGSYY | 3761 | ST | P | n/a |
| 87 | DPGG | 3717 | RY | n/a | SSE | YYYYMDV | 4683 |
| 88 | DGGS | 3687 | DS | n/a | GLG | RAFDI | 4544 |
| 89 | GGT | n/a | TT | n/a | PRP | RYFDY | 4572 |
| 90 | GGRG | 3703 | YCSGGSCYS | 3769 | RPL | FYYYYGMDV | 4657 |
| 91 | EGR | n/a | PA | n/a | EA | GNWFDP | 4606 |
| 92 | DGA | n/a | IVVVPAA | 3823 | LGG | RWFDP | 4614 |
| 93 | DGL | n/a | IAAAGT | 4447 | FS | GFDP | 4623 |
| 94 | EL | n/a | AAAG | 4453 | DL | DYYYMDV | 4714 |

TABLE 23-continued

Segments used in Exemplary Library Design 1 (ELD-1).
The sequences collectively form a theoretical segment
pool that comprises individual theoretical segment
pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 95 | EGG | n/a | GYCSGGSC | 3770 | GGG | PYYYGMDV | 4674 |
| 96 | LGG | n/a | SGWY | 4464 | AR | DP | n/a |
| 97 | DPA | n/a | DYGGN | 4355 | RE | HAFDI | 4541 |
| 98 | EGV | n/a | YYYDS | 4176 | PA | DNWFDP | 4594 |
| 99 | GSG | n/a | YSSG | 4462 | PTQ | LNWFDP | 4602 |
| 100 | GGP | n/a | YDSSGY | 4173 | AGG | AYYYYGMDV | 4666 |
| 101 | | | VAG | n/a | GGV | | |
| 102 | | | SSW | n/a | SI | | |
| 103 | | | GSGSY | 3987 | SAA | | |
| 104 | | | SSSS | 4480 | GGS | | |
| 105 | | | NW | n/a | GGA | | |
| 106 | | | DFWSGY | 4254 | GPG | | |
| 107 | | | QQLV | 4455 | PGG | | |
| 108 | | | YGGN | 4358 | AAE | | |
| 109 | | | YDSSG | 4178 | GGR | | |
| 110 | | | GYSYG | 4430 | TW | | |
| 111 | | | TV | n/a | GGP | | |
| 112 | | | NG | n/a | GGL | | |
| 113 | | | IVGAT | 3752 | VGG | | |
| 114 | | | IVGA | 3755 | GTG | | |
| 115 | | | YGSGSY | 3981 | NR | | |
| 116 | | | SSWY | 4444 | NTP | | |
| 117 | | | ST | n/a | PV | | |
| 118 | | | DFWSGYY | 4250 | EK | | |
| 119 | | | GSY | n/a | GVG | | |
| 120 | | | YYDSS | 4177 | KV | | |
| 121 | | | VGA | n/a | EKR | | |
| 122 | | | AT | n/a | QT | | |
| 123 | | | RP | n/a | SE | | |
| 124 | | | YYYGSGS | 3975 | SAL | | |
| 125 | | | GIAAAG | 4446 | FH | | |
| 126 | | | SGY | n/a | RH | | |
| 127 | | | TG | n/a | PTA | | |
| 128 | | | LT | n/a | HL | | |
| 129 | | | RD | n/a | WGT | | |
| 130 | | | WEL | n/a | REL | | |

TABLE 23-continued

Segments used in Exemplary Library Design 1 (ELD-1). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 131 | | | YSYG | 4433 | NT | | |
| 132 | | | TVT | n/a | HW | | |
| 133 | | | GYCSGGSCYS | 3767 | PKS | | |
| 134 | | | AR | n/a | DT | | |
| 135 | | | YYGSGSY | 3976 | DTL | | |
| 136 | | | RW | n/a | SK | | |
| 137 | | | DIVVVPA | 3822 | TGL | | |
| 138 | | | YSGS | 3762 | AYH | | |
| 139 | | | GYSSSW | 4436 | ISR | | |
| 140 | | | YSSSS | 4478 | GGT | | |
| 141 | | | YYYDSS | 4171 | QE | | |
| 142 | | | QL | n/a | | | |
| 143 | | | GYSGYD | 4386 | | | |
| 144 | | | GE | n/a | | | |
| 145 | | | MA | n/a | | | |
| 146 | | | DSS | n/a | | | |
| 147 | | | RF | n/a | | | |
| 148 | | | DTAMV | 4417 | | | |
| 149 | | | YYGSGSYY | 3973 | | | |
| 150 | | | VDTAMV | 4414 | | | |
| 151 | | | FGVV | 4293 | | | |
| 152 | | | EYSSS | 4477 | | | |
| 153 | | | TTV | n/a | | | |
| 154 | | | SWY | n/a | | | |
| 155 | | | IAARP | 4483 | | | |
| 156 | | | VE | n/a | | | |
| 157 | | | SIAA | 4484 | | | |
| 158 | | | YSGYD | 4389 | | | |
| 159 | | | DIVVVPAA | 3819 | | | |
| 160 | | | CSGGSC | 3775 | | | |
| 161 | | | DW | n/a | | | |
| 162 | | | TS | n/a | | | |
| 163 | | | RL | n/a | | | |
| 164 | | | YSS | n/a | | | |
| 165 | | | GN | n/a | | | |
| 166 | | | SN | n/a | | | |

TABLE 23-continued

Segments used in Exemplary Library Design 1 (ELD-1). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | H3-JH | SEQ ID NO |
|---|---|---|---|---|---|---|---|
| 167 | | | GYSY | 4432 | | | |
| 168 | | | YYDS | 4183 | | | |
| 169 | | | VDTAM | 4416 | | | |
| 170 | | | LE | n/a | | | |
| 171 | | | AVAGT | 4470 | | | |
| 172 | | | YSY | n/a | | | |
| 173 | | | SW | n/a | | | |
| 174 | | | SSG | n/a | | | |
| 175 | | | FGV | n/a | | | |
| 176 | | | VP | n/a | | | |
| 177 | | | VA | n/a | | | |
| 178 | | | SYY | n/a | | | |
| 179 | | | QWL | n/a | | | |
| 180 | | | GSG | n/a | | | |
| 181 | | | TIFGVV | 4280 | | | |
| 182 | | | AVA | n/a | | | |
| 183 | | | FWSGY | 4260 | | | |
| 184 | | | YSGSYY | 3759 | | | |
| 185 | | | IAVAG | 4469 | | | |
| 186 | | | YS | n/a | | | |
| 187 | | | YQL | n/a | | | |
| 188 | | | SIAAR | 4482 | | | |
| 189 | | | YCGGDC | 3868 | | | |
| 190 | | | NWNY | 3766 | | | |
| 191 | | | SSSWY | 4440 | | | |
| 192 | | | GIAVA | 4468 | | | |
| 193 | | | YSYGY | 4431 | | | |
| 194 | | | GIAAA | 4448 | | | |
| 195 | | | YYG | n/a | | | |
| 196 | | | AAG | n/a | | | |
| 197 | | | AV | n/a | | | |
| 198 | | | AYCGGDCY | 3863 | | | |
| 199 | | | YYGSGS | 3980 | | | |
| 200 | | | EY | n/a | | | |

TABLE 24

Segments used in Exemplary Library Design 2 (ELD-2).
The sequences collectively form a theoretical segment
pool that comprises individual theoretical segment pools
of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 1 | — | n/a | YYYDSSGYY | 4162 | — | n/a | DAFDI | 4538 |
| 2 | G | n/a | YGDY | 4350 | G | n/a | YYFDY | 4568 |
| 3 | D | n/a | DYGDY | 4348 | D | n/a | Y | n/a |
| 4 | A | n/a | YYYDSSGY | 4164 | A | n/a | FDY | n/a |
| 5 | V | n/a | YCSSTSCY | 3810 | V | n/a | DY | n/a |
| 6 | S | n/a | YYDSSGY | 4168 | S | n/a | YGMDV | 4640 |
| 7 | DR | n/a | YCSGGSCY | 3771 | DR | n/a | — | n/a |
| 8 | L | n/a | YCSSTSC | 3812 | L | n/a | LDY | n/a |
| 9 | R | n/a | GG | n/a | R | n/a | GAFDI | 4549 |
| 10 | DL | n/a | RG | n/a | DL | n/a | YFDY | 4567 |
| 11 | T | n/a | SGSY | 3763 | T | n/a | YYGMDV | 4639 |
| 12 | E | n/a | YYDSSGYY | 4165 | E | n/a | AFDI | 4539 |
| 13 | GR | n/a | SS | n/a | GR | n/a | PFDY | 4587 |
| 14 | GG | n/a | YDFWSGY | 4249 | GG | n/a | GMDV | 4641 |
| 15 | DG | n/a | GYCSSTSC | 3809 | DG | n/a | GWFDP | 4619 |
| 16 | DS | n/a | DY | n/a | DS | n/a | YYYYGMDV | 4637 |
| 17 | VG | n/a | YYYDSSG | 4167 | VG | n/a | IDY | n/a |
| 18 | EG | n/a | CSSTSCY | 3813 | EG | n/a | GYFDY | 4577 |
| 19 | P | n/a | YYDFWSGY | 4245 | P | n/a | GFDY | 4590 |
| 20 | GL | n/a | SSGWY | 4461 | GL | n/a | MDV | n/a |
| 21 | GS | n/a | AG | n/a | GS | n/a | VDY | n/a |
| 22 | DP | n/a | DSSGY | 4179 | DP | n/a | YYYGMDV | 4638 |
| 23 | GP | n/a | SSSW | 4443 | GP | n/a | NWFDP | 4595 |
| 24 | GA | n/a | VGAT | 3756 | GA | n/a | PDY | n/a |
| 25 | GV | n/a | SY | n/a | GV | n/a | WFDP | 4596 |
| 26 | H | n/a | DTAM | 4420 | H | n/a | NFDY | 4580 |
| 27 | DRG | n/a | IAAAG | 4449 | DRG | n/a | YWYFDL | 4527 |
| 28 | DQ | n/a | YSSSW | 4439 | DQ | n/a | NAFDI | 4565 |
| 29 | AG | n/a | GS | n/a | AG | n/a | HFDY | 4582 |
| 30 | DLG | n/a | YYDSSG | 4172 | DLG | n/a | SFDY | 4584 |
| 31 | DV | n/a | VG | n/a | DV | n/a | YYYYYGMDV | 4636 |
| 32 | Q | n/a | YSSSWY | 4437 | Q | n/a | DYYYGMDV | 4668 |
| 33 | N | n/a | YCSGGSC | 3773 | N | n/a | DFDY | 4581 |
| 34 | AP | n/a | YDSSGYY | 4169 | AP | n/a | YNWFDP | 4597 |
| 35 | GGG | n/a | GI | n/a | GGG | n/a | DYYYGMDV | 4655 |
| 36 | DH | n/a | GYCSGGSCY | 3768 | DH | n/a | YYYMDV | 4685 |

TABLE 24-continued

Segments used in Exemplary Library Design 2 (ELD-2). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 37 | VP | n/a | YSSS | 4442 | VP | n/a | LFDY | 4586 |
| 38 | SG | n/a | SSGW | 4463 | SG | n/a | DYFDY | 4566 |
| 39 | GRG | n/a | TA | n/a | GRG | n/a | NYYYYGMDV | 4654 |
| 40 | AR | n/a | DSSGYY | 4174 | AR | n/a | GDY | n/a |
| 41 | RG | n/a | GYCSSTSCY | 3807 | RG | n/a | YDY | n/a |
| 42 | ER | n/a | TTVT | 4352 | ER | n/a | SYFDY | 4571 |
| 43 | DA | n/a | YSSGWY | 4458 | DA | n/a | YYMDV | 4686 |
| 44 | AS | n/a | GW | n/a | AS | n/a | TFDY | 4589 |
| 45 | PL | n/a | LG | n/a | PL | n/a | YYYYYYGMDV | 4642 |
| 46 | DQG | n/a | DYGD | 4349 | DQG | n/a | FFDY | 4583 |
| 47 | VL | n/a | TVTT | 4353 | VL | n/a | SYYYYGMDV | 4658 |
| 48 | GT | n/a | AAA | n/a | GT | n/a | VFDY | 4591 |
| 49 | DGG | n/a | YSSGW | 4460 | DGG | n/a | YAFDI | 4540 |
| 50 | DSG | n/a | LV | n/a | DSG | n/a | SDY | n/a |
| 51 | VGG | n/a | YYDFWSGYY | 4243 | VGG | n/a | WYFDL | 4528 |
| 52 | F | n/a | YYDSSGYYY | 4163 | F | n/a | DWFDP | 4609 |
| 53 | AL | n/a | YYDFWSG | 4248 | AL | n/a | AFDY | 4592 |
| 54 | PS | n/a | YGD | n/a | PS | n/a | PYYYYGMDV | 4661 |
| 55 | ES | n/a | YG | n/a | ES | n/a | HYFDY | 4569 |
| 56 | ERG | n/a | GT | n/a | ERG | n/a | DV | n/a |
| 57 | GGV | n/a | YSGSY | 3760 | GGV | n/a | RFDY | 4585 |
| 58 | DRP | n/a | YYYGSGSY | 3972 | DRP | n/a | NYFDY | 4593 |
| 59 | EA | n/a | LR | n/a | EA | n/a | IFDY | 4588 |
| 60 | TP | n/a | SSS | n/a | TP | n/a | ADY | n/a |
| 61 | GPR | n/a | GD | n/a | GPR | n/a | HYYYGMDV | 4669 |
| 62 | LH | n/a | CSGGSCY | 3774 | LH | n/a | GYYYYYGMDV | 4651 |
| 63 | SR | n/a | GY | n/a | SR | n/a | DWYFDL | 4530 |
| 64 | LP | n/a | YCGGDCY | 3866 | LP | n/a | GYYYGMDV | 4677 |
| 65 | LG | n/a | QWLV | 4475 | LG | n/a | YYYMDV | 4684 |
| 66 | DT | n/a | IAAA | 4452 | DT | n/a | V | n/a |
| 67 | VA | n/a | QG | n/a | VA | n/a | FDP | n/a |
| 68 | SL | n/a | YCSSTSCYT | 3844 | SL | n/a | DDY | n/a |
| 69 | EGG | n/a | SG | n/a | EGG | n/a | GYYYYGMDV | 4664 |
| 70 | DRS | n/a | TTVTT | 4351 | DRS | n/a | YMDV | 4687 |
| 71 | K | n/a | QQL | n/a | K | n/a | NWYFDL | 4532 |
| 72 | DPG | n/a | IAVA | 4472 | DPG | n/a | PYFDY | 4574 |

TABLE 24-continued

Segments used in Exemplary Library Design 2 (ELD-2). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 73 | I | n/a | GDY | n/a | I | n/a | FDI | n/a |
| 74 | GD | n/a | YYYDSSGYYY | 4161 | GD | n/a | NDY | n/a |
| 75 | DGT | n/a | DGYN | 4411 | DGT | n/a | HYYYYYGMDV | 4643 |
| 76 | GPP | n/a | CSSTSC | 3814 | GPP | n/a | VYYYGMDV | 4678 |
| 77 | DPP | n/a | IVVVPAAI | 3849 | DPP | n/a | VYFDY | 4578 |
| 78 | RR | n/a | AVAG | 4473 | RR | n/a | SNWFDP | 4600 |
| 79 | EGV | n/a | AA | n/a | EGV | n/a | NYYYGMDV | 4667 |
| 80 | GF | n/a | DSSG | 4185 | GF | n/a | LYYYYGMDV | 4660 |
| 81 | GVG | n/a | VR | n/a | GVG | n/a | DYYYYYGMDV | 4635 |
| 82 | DPS | n/a | YDFWSG | 4253 | DPS | n/a | AAFDI | 4551 |
| 83 | VD | n/a | GYSSSWY | 4435 | VD | n/a | SWFDP | 4613 |
| 84 | GGT | n/a | SGW | n/a | GGT | n/a | SYYYYYGMDV | 4645 |
| 85 | DK | n/a | WG | n/a | DK | n/a | SYYYGMDV | 4671 |
| 86 | GTG | n/a | SGSYY | 3761 | GTG | n/a | P | n/a |
| 87 | DF | n/a | RY | n/a | DF | n/a | YYYYYMDV | 4683 |
| 88 | GQ | n/a | DS | n/a | GQ | n/a | RAFDI | 4544 |
| 89 | SP | n/a | TT | n/a | SP | n/a | RYFDY | 4572 |
| 90 | QG | n/a | YCSGGSCYS | 3769 | QG | n/a | FYYYYGMDV | 4657 |
| 91 | DLT | n/a | PA | n/a | DLT | n/a | GNWFDP | 4606 |
| 92 | AK | n/a | IVVVPAA | 3823 | AK | n/a | RWFDP | 4614 |
| 93 | GPS | n/a | IAAAGT | 4447 | GPS | n/a | GFDP | 4623 |
| 94 | QR | n/a | AAAG | 4453 | QR | n/a | DYYYMDV | 4714 |
| 95 | VR | n/a | GYCSGGSC | 3770 | VR | n/a | PYYYGMDV | 4674 |
| 96 | DSP | n/a | SGWY | 4464 | DSP | n/a | DP | n/a |
| 97 | DPL | n/a | DYGGN | 4355 | DPL | n/a | HAFDI | 4541 |
| 98 | EGR | n/a | YYYDS | 4176 | EGR | n/a | DNWFDP | 4594 |
| 99 | GRRG | 4789 | YSSG | 4462 | GRRG | 4789 | LNWFDP | 4602 |
| 100 | EV | n/a | YDSSGY | 4173 | EV | n/a | AYYYYGMDV | 4666 |
| 101 | | | VAG | n/a | RP | n/a | | |
| 102 | | | SSW | n/a | GH | n/a | | |
| 103 | | | GSGSY | 3987 | DGR | n/a | | |
| 104 | | | SSSS | 4480 | AA | n/a | | |
| 105 | | | NW | n/a | DD | n/a | | |
| 106 | | | DFWSGY | 4254 | W | n/a | | |
| 107 | | | QQLV | 4455 | GGS | n/a | | |
| 108 | | | YGGN | 4358 | DIS | n/a | | |

TABLE 24-continued

Segments used in Exemplary Library Design 2 (ELD-2).
The sequences collectively form a theoretical segment
pool that comprises individual theoretical segment pools
of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 109 | | | YDSSG | 4178 | GGA | | n/a | |
| 110 | | | GYSYG | 4430 | GK | | n/a | |
| 111 | | | TV | | DGP | | n/a | |
| 112 | | | NG | | DLK | | n/a | |
| 113 | | | IVGAT | 3752 | ET | | n/a | |
| 114 | | | IVGA | 3755 | TT | | n/a | |
| 115 | | | YGSGSY | 3981 | VH | | n/a | |
| 116 | | | SSWY | 4444 | AE | | n/a | |
| 117 | | | ST | | VS | | n/a | |
| 118 | | | DFWSGYY | 4250 | LGG | | n/a | |
| 119 | | | GSY | | C | | n/a | |
| 120 | | | YYDSS | 4177 | DKG | | n/a | |
| 121 | | | VGA | | HA | | n/a | |
| 122 | | | AT | | VI | | n/a | |
| 123 | | | RP | | HP | | n/a | |
| 124 | | | YYYGSGS | 3975 | GGE | | n/a | |
| 125 | | | GIAAAG | 4446 | EP | | n/a | |
| 126 | | | SGY | | EF | | n/a | |
| 127 | | | TG | | DRN | | n/a | |
| 128 | | | LT | | DWG | | n/a | |
| 129 | | | RD | | GE | | n/a | |
| 130 | | | WEL | | DRA | | n/a | |
| 131 | | | YSYG | 4433 | VN | | n/a | |
| 132 | | | TVT | | DRE | | n/a | |
| 133 | | | GYCSGGSCYS | 3767 | DLA | | n/a | |
| 134 | | | AR | | EN | | n/a | |
| 135 | | | YYGSGSY | 3976 | VT | | n/a | |
| 136 | | | RW | | HG | | n/a | |
| 137 | | | DIVVPA | 3822 | RA | | n/a | |
| 138 | | | YSGS | 3762 | M | | n/a | |
| 139 | | | GYSSSW | 4436 | DVP | | n/a | |
| 140 | | | YSSSS | 4478 | GAP | | n/a | |
| 141 | | | YYYDSS | 4171 | GLG | | n/a | |
| 142 | | | QL | | GPG | | n/a | |
| 143 | | | GYSGYD | 4386 | PG | | n/a | |
| 144 | | | GE | | DSS | | n/a | |

TABLE 24-continued

Segments used in Exemplary Library Design 2 (ELD-2). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 145 | | | MA | n/a | SS | n/a | | |
| 146 | | | DSS | n/a | AGG | n/a | | |
| 147 | | | RF | n/a | GGR | n/a | | |
| 148 | | | DTAMV | 4417 | GPN | n/a | | |
| 149 | | | YYGSGSYY | 3973 | DRL | n/a | | |
| 150 | | | VDTAMV | 4414 | GRR | n/a | | |
| 151 | | | FGVV | 4293 | DSGG | 3723 | | |
| 152 | | | EYSSS | 4477 | TR | n/a | | |
| 153 | | | TTV | n/a | DLS | n/a | | |
| 154 | | | SWY | n/a | RGG | n/a | | |
| 155 | | | IAARP | 4483 | Y | n/a | | |
| 156 | | | VE | n/a | EVR | n/a | | |
| 157 | | | SIAA | 4484 | LI | n/a | | |
| 158 | | | YSGYD | 4389 | TF | n/a | | |
| 159 | | | DIVVVPAA | 3819 | LK | n/a | | |
| 160 | | | CSGGSC | 3775 | DLE | n/a | | |
| 161 | | | DW | n/a | GY | n/a | | |
| 162 | | | TS | n/a | DGS | n/a | | |
| 163 | | | RL | n/a | GVR | n/a | | |
| 164 | | | YSS | n/a | GQR | n/a | | |
| 165 | | | GN | n/a | EGL | n/a | | |
| 166 | | | SN | n/a | VLG | n/a | | |
| 167 | | | GYSY | 4432 | QP | n/a | | |
| 168 | | | YYDS | 4183 | VM | n/a | | |
| 169 | | | VDTAM | 4416 | VE | n/a | | |
| 170 | | | LE | n/a | DQGG | 4790 | | |
| 171 | | | AVAGT | 4470 | PN | n/a | | |
| 172 | | | YSY | n/a | DGL | n/a | | |
| 173 | | | SW | n/a | PV | n/a | | |
| 174 | | | SSG | n/a | HR | n/a | | |
| 175 | | | FGV | n/a | AD | n/a | | |
| 176 | | | VP | n/a | DLF | n/a | | |
| 177 | | | VA | n/a | LD | n/a | | |
| 178 | | | SYY | n/a | GGD | n/a | | |
| 179 | | | QWL | n/a | DRR | n/a | | |
| 180 | | | GSG | n/a | DHH | n/a | | |

TABLE 24-continued

Segments used in Exemplary Library Design 2 (ELD-2). The sequences collectively form a theoretical segment pool that comprises individual theoretical segment pools of TN1, DH, N2, and H3-JH segments.

| Segment No. | TN1 | SEQ ID NO | DH | SEQ ID NO | N2 | SEQ ID NO | H3-JH | SEQ ID NO |
|---|---|---|---|---|---|---|---|---|
| 181 | | | TIFGVV | 4280 | DW | | n/a | |
| 182 | | | AVA | n/a | DAS | | n/a | |
| 183 | | | FWSGY | 4260 | GW | | n/a | |
| 184 | | | YSGSYY | 3759 | SV | | n/a | |
| 185 | | | IAVAG | 4469 | GLR | | n/a | |
| 186 | | | YS | n/a | DGA | | n/a | |
| 187 | | | YQL | n/a | LA | | n/a | |
| 188 | | | SIAAR | 4482 | EEG | | n/a | |
| 189 | | | YCGGDC | 3868 | AV | | n/a | |
| 190 | | | NWNY | 3766 | VQ | | n/a | |
| 191 | | | SSSWY | 4440 | AH | | n/a | |
| 192 | | | GIAVA | 4468 | RS | | n/a | |
| 193 | | | YSYGY | 4431 | WA | | n/a | |
| 194 | | | GIAAA | 4448 | LR | | n/a | |
| 195 | | | YYG | n/a | GSG | | n/a | |
| 196 | | | AAG | n/a | GGSG | | 3706 | |
| 197 | | | AV | n/a | DLR | | n/a | |
| 198 | | | AYCGGDCY | 3863 | VWG | | n/a | |
| 199 | | | YYGSGS | 3980 | HL | | n/a | |
| 200 | | | EY | n/a | EH | | n/a | |

TABLE 25

Segments used in Exemplary Library Design 3 (ELD-3). The sequences collectively form a theoretical segment pool that comprises individual theoretical segment pools of TN1, DH, N2, and H3-JH segments.

| Segment No. | TN1 (plus AR or AK)[1] | SEQ ID NO | TN1 Nucleotides (plus AR or AK)[1] | DH | SEQ ID NO DH | DH Nucleotides | N2 | SEQ ID NO N2 | N2 Nucleotides | H3-JH | SEQ ID NO H3-JH | H3-JH Nucleotides |
|---|---|---|---|---|---|---|---|---|---|---|---|---|
| 1 | AR | n/a | GCCAGA | GT | n/a | GGTACT | – | n/a | – | – | n/a | – |
| 2 | ARE | n/a | GCCAGAGAG | TT | n/a | ACTACT | A | n/a | GCT | Y | n/a | TAT |
| 3 | ARD | n/a | GCCAGAGAC | TG | n/a | ACAGGC | D | n/a | GAT | DI | n/a | GATATT |
| 4 | ARG | n/a | GCCAGAGGA | ER | n/a | GAGCGT | E | n/a | GAG | DL | n/a | GACTTG |
| 5 | AREG | 4791 | GCCAGAGAGGGA | QLE | 4963 | CAATTAGAG | F | n/a | TTC | DP | n/a | GATCCT |
| 6 | ARDG | 4792 | GCCAGAGACGGA | LER | 4964 | TTAGAGCGT | G | n/a | GGC | DV | n/a | GATGTA |
| 7 | ARGG | 4793 | GCCAGAGGTGGA | VGAT | 4965 | GTTGGGCAACT | H | 5135 | CAT | DY | n/a | GACTAT |
| 8 | ARR | n/a | GCCAGGAGA | YSG | n/a | TATAGTGGT | I | 5136 | ATC | QH | n/a | CAGCAC |
| 9 | ARER | 4794 | GCCAGAGAGAGA | YSGSY | 4966 | TACTCTGGCTCTTAT | K | 5136 | AAA | ADY | n/a | GCTGATTAT |
| 10 | ARDR | 4795 | GCCAGAGACAGA | VG | 4967 | GTAGGC | L | n/a | CTG | DDY | n/a | GATGACTAT |
| 11 | ARGR | 4796 | GCCAGAGGCAGA | AT | 4968 | GCCACT | M | n/a | ATG | FDI | n/a | TTTGACATT |
| 12 | ARS | n/a | GCCAGATCT | WEL | n/a | TGGGAGCTT | P | n/a | CCT | FDL | n/a | TTCGACTTA |
| 13 | ARES | 4797 | GCCAGAGAATCT | YS | 4969 | TACAGC | Q | n/a | CAG | FDP | n/a | TTTGACCCT |
| 14 | ARDS | 4798 | GCCAGAGACTCT | SG | 4970 | AGTGGT | R | n/a | AGG | FDY | n/a | TTCGACTAT |
| 15 | ARGS | 4799 | GCCAGAGGTTCT | GS | 4971 | GGTTCT | S | n/a | TCA | FQH | n/a | TTCCAGCAC |
| 16 | ARP | n/a | GCCAGACCT | SY | n/a | AGCTAC | T | n/a | ACC | GDY | n/a | GGTGACTAC |
| 17 | ARDP | 4800 | GCCAGAGACCCT | CSSTSC | 4972 | TGTAGTAGTACAAGTTGC | V | 5137 | GTT | IDY | n/a | ATCGACTAT |
| 18 | ARGP | 4801 | GCCAGAGGGCCT | CSSTSCY | 4973 | TGCTCATCTACATCATGCTAT | W | 5138 | TGG | LDY | n/a | TTGGACTAT |
| 19 | ARL | n/a | GCCAGATTG | CSSTSC | n/a | TATTGTTCAAGTACATCTTGT | Y | 5139 | TAC | MDV | n/a | ATGGATGTG |
| 20 | ARDL | 4802 | GCCAGAGACTTG | YCSSTSC | 4974 | GGGTATTGCTCCAGTACCTCATGT | AD | 5140 | GCTGAT | PDY | n/a | CCAGATTAT |
| 21 | ARGL | 4803 | GCCAGAGGGTTG | YCSSTSCY | 4975 | TACTGCAGCAGCACAAGTTGTTAC | AG | 5141 | GCAGGC | SDY | n/a | TCTGATTAC |
| 22 | ARA | n/a | GCCAGAGCT | GYCSSTSCY | n/a | GGGTATTGCAGTTCAACTAGTTGTTAT | AP | 5142 | GCCCCA | VDY | n/a | GTTGACTAC |

TABLE 25-continued

Segments used in Exemplary Library Design 3 (ELD-3). The sequences collectively form a theoretical segment pool that comprises individual theoretical segment pools of TN1, DH, N2, and H3-JH segments.

| Segment No. | TN1 (plus AR or AK)[1] | SEQ ID NO | TN1 Nucleotides (plus AR or AK)[1] | DH | SEQ ID NO DH | DH Nucleotides | N2 | SEQ ID NO N2 | N2 Nucleotides | H3-JH | SEQ ID NO H3-JH | H3-JH Nucleotides | SEQ ID NO |
|---|---|---|---|---|---|---|---|---|---|---|---|---|---|
| 23 | AREA | 4804 | GCCAGAGAGGCT | YCSSTSCYT | 4976 | TACTGTTCATCAACCTCCTGTTATACT | AQ | 5143 | GCTCAG | YDY | n/a | TATGATTAC | n/a |
| 24 | ARDA | 4805 | GCCAGAGATGCT | PAA | 4977 | CCTGCCGCT | AR | n/a | GCTAGG | AFDI | 4539 | GCCTTCGATATC | 5251 |
| 25 | ARGA | 4806 | GCCAGAGGTGCT | CSGGSCY | 4978 | TGCTCTGGGGGTAGCTGCTAT | AS | 5144 | GCTAGT | AFDY | 4592 | GCCTTCGATTAC | 5252 |
| 26 | ART | n/a | GCCAGAACT | YCSGGSC | n/a | TACTGTAGCGGTGGTAGTTGC | AT | 5145 | GCTACC | DFDY | 4581 | GATTTCGACTAT | 5253 |
| 27 | ARET | 4807 | GCCAGAGAGACT | GYCSGGSC | 4979 | GGATACTGTAGTGGCGGATCCTGC | AY | 5146 | GCCTAC | FFDY | 4583 | TTCTTCGATTAC | 5254 |
| 28 | ARDT | 4808 | GCCAGAGATACT | YCSGGSCY | 4980 | TACTGCTCCGGAGGAAGTTGTTAT | DA | 5147 | GACGCC | GFDP | 4623 | GGGTTTGACCCA | 5255 |
| 29 | ARGT | 4809 | GCCAGAGGCACT | GYCSGGSCY | 4981 | GGTTATTGCAGTGGGGGTTCATGTTAC | DD | 5148 | GACGAT | GFDY | 4590 | GGGTTCGACTAC | 5256 |
| 30 | ARV | n/a | GCCAGAGTG | YCSGGSCYS | n/a | TACTGTTCCGGAGGTAGCTGTTACTCT | DE | 5149 | GACGAG | GMDV | 4641 | GGCATGGATGTA | 5257 |
| 31 | AREV | 4810 | GCCAGAGAGGTG | RI | 4982 | AGAATC | DG | n/a | GATGGT | HFDY | 4582 | CACTTTGACTAT | 5258 |
| 32 | ARDV | 4811 | GCCAGAGATGTG | GY | 4983 | GGATAT | DL | n/a | GACTTG | IFDY | 4588 | ATATTCGATTAC | 5259 |
| 33 | ARGV | 4812 | GCCAGAGGGGTG | GG | 4984 | GGCGGT | DP | n/a | GACCCT | LFDY | 4586 | TTATTTGATTAT | 5260 |
| 34 | AREGG | 4813 | GCCAGAGAGGAGGA | ATP | 4985 | GCTACCCCT | DS | n/a | GACTCC | NFDY | 4580 | AACTTTGATTAC | 5261 |
| 35 | ARDGG | 4814 | GCCAGAGATGTGGA | DI | 4986 | GACATC | DY | n/a | GATTAT | PFDY | 4587 | CCCTTCGACTAT | 5262 |
| 36 | ARGGG | 4815 | GCCAGAGGTGGAGGA | TP | 4987 | ACTCCT | EA | n/a | GAGGCC | RFDY | 4585 | AGGTTTGACTAC | 5263 |
| 37 | ARGGR | 4816 | GCCAGAGGACGCAGA | GD | 4988 | GGAGAT | ED | n/a | GAGGAC | SFDY | 4584 | AGTTTCGACTAC | 5264 |
| 38 | ARGGS | 4817 | GCCAGAGGCGGTTCT | AYCGGDCY | 4989 | GCCTATTGCGGTGGTGACTGCTAT | EG | 5150 | GAAGGA | TFDY | 4589 | ACATTTGACTAC | 5265 |
| 39 | ARGGP | 4818 | GCCAGAGGTGGCCT | AYCGGDC | 4990 | GCATATTGCGGAGGGGATTGC | EK | 5151 | GAGAAA | VFDY | 4591 | GTTTTCGATTAT | 5266 |
| 40 | ARGGA | 4819 | GCCAGAGGAGGTGCT | YCCGGDCY | 4991 | TATTGTGTGGGGACTGCTAT | ER | 5152 | GAAAGA | WFDP | 4596 | TGGTTCGATCCA | 5267 |
| 41 | ARDGT | 4820 | GCCAGAGGACGTACT | YCCGGDC | 4992 | TACTGCGGAGGCGATTGC | ES | 5153 | GAATCT | YFDL | 4529 | TATTTCGACTTA | 5268 |
| 42 | ARGGT | 4821 | GCCAGAGGTGGAACT | HI | 4993 | CACATC | ET | n/a | GAAACA | YFDY | 4567 | TACTTCGATTAC | 5269 |
| 43 | AREGV | 4822 | GCCAGAGGAGGGAGTG | TA | 4994 | ACAGCT | FA | n/a | TTCGCT | YFQH | 4489 | TATTTCCAGCAC | 5270 |
| 44 | ARGGV | 4823 | GCCAGAGGTGGCGTG | GYCSSTSCYA | 4995 | GGGTACTGCTCTAGCACTTCATGCTACGCC | FH | 5154 | TTCCAT | YMDV | 4687 | TATATGGATGTC | 5271 |

TABLE 25-continued

Segments used in Exemplary Library Design 3 (ELD-3). The sequences collectively form a theoretical segment pool that comprises individual theoretical segment pools of TN1, DH, N2, and H3-JH segments.

| Seg-ment No. | TN1 (plus AR or AK)[1] | SEQ ID NO | TN1 Nucleotides (plus AR or AK)[1] | DH | SEQ ID NO | DH Nucleotides | N2 | SEQ ID NO | N2 Nucleotides | H3-JH | SEQ ID NO | H3-JH Nucleotides | SEQ ID NO |
|---|---|---|---|---|---|---|---|---|---|---|---|---|---|
| 45 | ARRG | 4824 | GCCAGAAGAGGA | SS | 4996 | AGTTCT | FL | n/a | TTCTTG | DAFDI | 4538 | GATGCTTTCGACATA | 5272 |
| 46 | ARERG | 4825 | GCCAGAGAGCGTGGA | ST | 4997 | AGTACT | FR | n/a | TTTAGG | DWFDP | 4609 | GACTGGTTTGACCCC | 5273 |
| 47 | ARDRG | 4826 | GCCAGAGATCGTGGA | TS | 4998 | ACCAGC | FS | n/a | TTTAGT | DYFDY | 4566 | GACTACTTTGATTAC | 5274 |
| 48 | ARGRG | 4827 | GCCAGAGGCAGGGGA | PAAMP | 4999 | CCAGCAGCTATGCCT | GA | 5155 | GGAGCC | EYFQH | 4488 | GAATACTTCCAACAC | 5275 |
| 49 | ARSG | 4828 | GCCAGAGATCAGGA | PA | 5000 | CCCGCC | GD | n/a | GGTGAT | GAFDI | 4549 | GGCGCATTCGATATT | 5276 |
| 50 | ARDSG | 4829 | GCCAGAGACTCAGGA | MP | 5001 | ATGCCT | GE | n/a | GGTGAG | GWFDP | 4619 | GGGTGGTTTGATCCA | 5277 |
| 51 | ARDPG | 4830 | GCCAGAGATCCAGGA | VYAIP | 5002 | GTCTATGCAATTCCT | GG | 5156 | GGAGGC | GYFDY | 4577 | GGCTATTTTGACTAC | 5278 |
| 52 | ARLG | 4831 | GCCAGAGATTGGGA | WFGE | 5003 | TGGTTTGGGGAG | GL | 5157 | GGATTG | HAFDI | 4541 | CATGCTTTTGATATA | 5279 |
| 53 | ARDLG | 4832 | GCCAGAGACTTGGGA | FGE | 5004 | TTTGGAGAG | GP | n/a | GGACCA | HYFDY | 4569 | CATTACTTCGATTAC | 5280 |
| 54 | ARAG | 4833 | GCCAGAGCTGGA | GEL | 5005 | GGCGAGCTT | GR | n/a | GGTAGG | NAFDI | 4565 | AACGCATTCGATATT | 5281 |
| 55 | ARVG | 4834 | GCCAGAGTGGGA | WFG | 5006 | TGGTTCGGT | GS | n/a | GGCAGT | NWFDP | 4595 | AACTGTTTCGATCCA | 5282 |
| 56 | ARGVG | 4835 | GCCAGAGGCGTAGGA | GSG | 5007 | GGTTCAGGC | GT | n/a | GGAACA | NYFDY | 4593 | AATTATTTCGACTAT | 5283 |
| 57 | ARPR | 4836 | GCCAGACCCAGA | SGSY | 5008 | AGTGGATCTTAT | GV | 5158 | GGAGTT | PYFDY | 4574 | CCCTACTTTGACTAT | 5284 |
| 58 | ARGPR | 4837 | GCCAGAGGACCAAGA | YYGS | 5009 | TATTATGGCAGT | GW | 5159 | GGATGG | RAFDI | 4544 | AGAGCCTTTGATATC | 5285 |
| 59 | ARPS | 4838 | GCCAGACCATCT | YYYG | 5010 | TACTACTATGGC | GY | 5160 | GGATAT | RYFDY | 4572 | AGGTACTTCGATTAC | 5286 |
| 60 | ARGPS | 4839 | GCCAGAGATCCCTCT | GSGSY | 5011 | GGCAGCGGTTCCTAC | HE | 5161 | CATGAG | SWFDP | 4613 | TCATGTTTCGACCCC | 5287 |
| 61 | ARDPS | 4840 | GCCAGAGGACCTTCT | SGSYY | 5012 | AGTGGATCCTATTAC | HL | 5162 | CATTTG | SYFDY | 4571 | AGTTACTTTGACTAT | 5288 |
| 62 | ARDPP | 4841 | GCCAGAGACCCACCT | YYYGSG | 5013 | TATTACTACGGGTCTGGC | HP | 5163 | CATCCT | TYFDY | 4576 | ACTTATTTCGACTAC | 5289 |
| 63 | ARGPP | 4842 | GCCAGAGGACCGCCT | SGS | 5014 | AGCGGCAGT | HS | n/a | CACTCC | VAFDI | 4550 | GTGGCCTTCGACATT | 5290 |
| 64 | ARPL | 4843 | GCCAGACCGTTG | YYYGSGS | 5015 | TATTACTACGGATCTGGCTCT | IF | 5164 | ATCTTC | VYFDY | 4578 | GTCTATTTTGATTAT | 5291 |
| 65 | ARDPL | 4844 | GCCAGAGATCCTTTG | YYYGSGSY | 5016 | TATTACTATGGCTCTGGTAGCTAC | IG | 5165 | ATCGGC | WYFDL | 4528 | TGGTATTCGATTTG | 5292 |
| 66 | ARRP | 4845 | GCCAGAAGGCCT | YGS | 5017 | TATGGCTCC | IR | n/a | ATAAGG | YAFDI | 4540 | TACGCATTCGACATC | 5293 |

TABLE 25-continued

Segments used in Exemplary Library Design 3 (ELD-3). The sequences collectively form a theoretical segment pool that comprises individual theoretical segment pools of TN1, DH, N2, and H3-JH segments.

| Seg-ment No. | TN1 (plus AR or AK)[1] | SEQ ID NO | TN1 Nucleotides (plus AR or AK)[1] | SEQ ID NO | DH | SEQ ID NO | DH Nucleotides | SEQ ID NO | N2 | SEQ ID NO | N2 Nucleotides | H3-JH | SEQ ID NO | H3-JH Nucleotides | SEQ ID NO |
|---|---|---|---|---|---|---|---|---|---|---|---|---|---|---|---|
| 67 | ARDRP | 4846 | GCCAGAGACCGTCCT | 5018 | YYG | n/a | TACTATGGT | n/a | IS | ATCAGT | YGMDV | 4640 | TACGGCATGGACGTG | 5294 |
| 68 | ARSP | 4847 | GCCAGATCACCT | 5019 | YYY | n/a | TATTATTAT | n/a | KG | AAAGGA | YYFDY | 4568 | TATTATTTGATTAC | 5295 |
| 69 | ARLP | 4848 | GCCAGACTTCCT | 5020 | MVRG | 4017 | ATGGTAAGAGGT | 5166 | KR | AAGAGA | YYMDV | 4686 | TATTATATGGACGTC | 5296 |
| 70 | ARAP | 4849 | GCCAGAGCCCCT | 5021 | TMVRG | 4010 | ACCATGCTGAGGGGT | 5167 | KV | AAAGTG | AEYFQH | 4526 | GCAGAGAGTACTTCCAGCAC | 5297 |
| 71 | ARTP | 4850 | GCCAGAACTCCT | 5022 | RGV | n/a | AGAGAGTT | n/a | LD | TTGGAT | DNWFDP | 4594 | GACAATTGGTTTGATCCC | 5298 |
| 72 | ARVP | 4851 | GCCAGAGTCCCT | 5023 | VRG | n/a | GTCAGAGGC | n/a | LE | TTAGAG | DWYFDL | 4530 | GATTGGTACTTCGACTTG | 5299 |
| 73 | ARVGG | 4852 | GCCAGAGTTGGAGGA | 5024 | FG | n/a | TTCGGC | n/a | LG | TTAGGT | GNWFDP | 4606 | GGGAATTGGTTTGATCCT | 5300 |
| 74 | ARQ | n/a | GCAAGACAG | n/a | GE | n/a | GGCGAG | n/a | LH | TTACAT | NWYFDL | 4532 | AACTGGTATTTCGACTTA | 5301 |
| 75 | ARH | n/a | GCCAGACAC | 5025 | YG | n/a | TACGGC | n/a | LL | TTATTG | PNWFDP | 4603 | CCCAATTGGTTTGATCCA | 5302 |
| 76 | ARDQ | 4853 | GCCAGGGACCAG | 5026 | VR | n/a | GTGCGT | n/a | LP | TTACCA | SNWFDP | 4600 | AGTAATTGGTTTGACCCC | 5303 |
| 77 | ARDH | 4854 | GCAAGAGACCAC | 5027 | RG | n/a | AGAGGT | n/a | LR | TTGAGG | YNWFDP | 4597 | TATAATTGGTTTGATCCT | 5304 |
| 78 | ARAR | 4855 | GCAAGGGCTAGA | 5028 | FRE | n/a | TTCAGGGAG | n/a | LS | TTAAGC | YWYFDL | 4527 | TATTGGTATTTGATTTG | 5305 |
| 79 | ARAS | 4856 | GCTAGGGCATCT | 5029 | RE | n/a | AGAGAG | n/a | LT | TTGACA | YYGMDV | 4639 | TACTATGGGATGGACGTG | 5306 |
| 80 | ARDQG | 4857 | GCTAGGGATCAGGGA | 5030 | QG | n/a | CAAGGT | n/a | LV | TTGGTA | YYYMDV | 4685 | TACTATTACATGGACGTT | 5307 |
| 81 | ARSR | 4858 | GCTAGATCAAGA | 5031 | LR | n/a | TTACGT | n/a | LW | TTGTGG | YYYGMDV | 4638 | TATTATTACGGTATGGACGTC | 5308 |
| 82 | ARDRS | 4859 | GCCAGGGACAGGTCT | 5032 | YDYDVWGSYAYT | 4070 | TACTATGATTACGTCTGGGGGTCTTATGCTTACACT | 5168 | LY | TTGTAC | YYYYMDV | 4684 | TACTATTACATGATGGACGTC | 5309 |
| 83 | ARSL | 4860 | GCTAGATCTTTG | 5033 | YDYDVWGSYAY | 4071 | TACTACGACATATGTATGGGGCTCATATGCTTAC | 5169 | MG | ATGGGC | DYYYGMDV | 4668 | GACTATTATTACGGTATGGATGTT | 5310 |
| 84 | ARLH | 4861 | GCTAGGTTGCAC | 5034 | YDYDVWGSYA | 4073 | TACTACGATTACGTATGGGGAAGCTACGCT | 5170 | MT | ATGACC | GYYYGMDV | 4677 | GGCTACTATTATGGTATGGACGTC | 5311 |
| 85 | ARDLT | 4862 | GCCAGGGATTTGACT | 5035 | YDYVWGSYA | 4074 | TATGATTACGTGTGGGGTCATACGCATAC | 5171 | PA | CCTGCT | HYYYGMDV | 4669 | CATTACTACTATGGATGGACGTC | 5312 |
| 86 | ARK | n/a | GCCAGAAAG | n/a | DY | n/a | GATTAC | n/a | PD | CCTGAT | NYYYMDV | 4713 | AACTACTATTATTATATGGATGTC | 5313 |
| 87 | ARAE | 4863 | GCAAGAGCCGAG | 5035 | WG | n/a | TGGGGC | n/a | PE | CCTGAG | PYYYYMDV | 4720 | CCCTACTACTACTATATGGATGTG | 5314 |

TABLE 25-continued

Segments used in Exemplary Library Design 3 (ELD-3). The sequences collectively form a theoretical segment pool that comprises individual theoretical segment pools of TN1, DH, N2, and H3-JH segments.

| Segment No. | TN1 (plus AR or AK)[1] | SEQ ID NO | TN1 Nucleotides (plus AR or AK)[1] | SEQ ID NO | DH | SEQ ID NO | DH Nucleotides | SEQ ID NO | N2 | SEQ ID NO | N2 Nucleotides | H3-JH | SEQ ID NO | H3-JH Nucleotides | SEQ ID NO |
|---|---|---|---|---|---|---|---|---|---|---|---|---|---|---|---|
| 88 | ARDLS | 4864 | GCAAGGGATTTGTCT | 5036 | DYVWGSYAYT | 4075 | GATTATGTGTGGGGGTCTTACGCCTACACC | 5172 | PF | CCTTTC | RYYYYMDV | 4718 | AGGTATTACTACTACATGGACGTC | 5315 |
| 89 | ARGD | 4865 | GCTAGGGGGAC | 5037 | YDVVWGSYA | 4077 | TACGACTATGTGTGGGGTTCCTATGCT | 5173 | PG | CCTGGT | YYYYGMDV | 4637 | TACTATTATTATGGGATGGATGATGTA | 5316 |
| 90 | ARRR | 4866 | GCTAGGAGGAGA | 5038 | YDVS | 4183 | TACTACGATTCC | 5174 | PH | CCACAT | DYYYYGMDV | 4655 | GATTACTATTATTACGGAATGGAT GTT | 5317 |
| 91 | ARDK | 4867 | GCTAGAGATAAG | 5039 | YYYD | 4182 | TATTATTATGAC | 5175 | PL | CCATTA | GYYYYGMDV | 4664 | GGGTATTACTACTACGGCATGGAC GTA | 5318 |
| 92 | ARVS | 4868 | GCTAGAGTATCT | 5040 | DSSGY | 4179 | GACAGTTCCGGTAC | 5176 | PP | CCTCCA | NYYYYGMDV | 4654 | AATTACTATTACTATGGCATGGAT GTG | 5319 |
| 93 | ARDRL | 4869 | GCCAGACAGGTTG | 5041 | YDSSG | 4178 | TATGATAGCTCAGGT | 5177 | PQ | CCTCAG | PYYYYGMDV | 4661 | CCAATATTACTATTACGGCATGGAT GTC | 5320 |
| 94 | ARGQ | 4870 | GCTAGGGGCCAG | 5042 | YDSS | 4177 | TACTATGACTCATCC | 5178 | PR | CCAAGG | SYYYYGMDV | 4658 | AGCTACTACTACTACGGAATGGAC GTC | 5321 |
| 95 | ARVR | 4871 | GCCAGGTCAGA | 5043 | YYYDS | 4176 | TATTATTACGATAGT | 5179 | PS | CCTTCT | YYYYYGMDV | 4636 | TACTACTACTATTACGGTATGGAC GTA | 5322 |
| 96 | ARAK | 4872 | GCTAGGGCTAAG | 5044 | GYY | n/a | GGATATTAC | n/a | PT | CCTACA | DYYYYYMDV | 4681 | GATTATTATTACTACTACATG GATGTA | 5323 |
| 97 | ARGK | 4873 | GCCAGGGGTAAG | 5045 | DSSGYY | 4174 | GATTCTTCCGGTACTAC | 5180 | PV | CCTGTT | GYYYYYGMDV | 4651 | GGTTATTATTACTACTATGGGATG GATGTA | 5324 |
| 98 | ARDIS | 4874 | GCAAGGGATATTTCT | 5046 | YDSSGY | 4173 | TATGATTCCAGCGGATAC | 5181 | QG | CAGGGC | HYYYYYMDV | 4643 | CACTACTATTATTATTACGGGAT GGATGTA | 5325 |
| 99 | ARDFT | 4875 | GCTAGGGATTTCACT | 5047 | YYDSSG | 4172 | TACTACGATAGCTCCGGT | 5182 | QL | CAATTA | RYYYYYMDV | 4692 | AGATACTACTACTATTATTACAT GGATGTA | 5326 |
| 100 | ARQG | 4876 | GCCAGGCAGGGA | 5048 | YYYDSS | 4171 | TATTATTACGACTCTTCC | 5183 | QP | CAGCCA | YYYYYYGMDV | 4642 | TATTACTACTATTACTATGGTAT GGACGTT | 5327 |
| 101 | AK | n/a | GCCAAG | n/a | YDSSGYY | 4169 | TACGACTCTTCTCTGGTTATTAC | 5184 | QS | CAGTCA | | | | |
| 102 | AKE | n/a | GCCAAGGAG | n/a | YDSSGY | 4168 | TATTATGACAGCAGCGGGTAT | 5185 | QT | CAGACT | | | | |
| 103 | AKD | n/a | GCCAAGGAC | n/a | YYYDSSG | 4167 | TACTACTACGATTCCAGCGGT | 5186 | RA | AGGGCT | | | | |

TABLE 25-continued

Segments used in Exemplary Library Design 3 (ELD-3). The sequences collectively form a theoretical segment pool that comprises individual theoretical segment pools of TN1, DH, N2, and H3-JH segments.

| TN1 Seg- ment No. | TN1 (plus AR or AK)[1] | SEQ ID NO | TN1 Nucleotides (plus AR or AK)[1] | SEQ ID NO | DH | SEQ ID NO | DH Nucleotides | SEQ ID NO | N2 | Nucleotides N2 | SEQ ID NO | H3-JH | SEQ ID NO | H3-JH Nucleotides |
|---|---|---|---|---|---|---|---|---|---|---|---|---|---|---|
| 104 | AKG | n/a | GCCAAGGGA | n/a | YDSSGYYY | 4166 | TACGAGCAGTTCCGGATATTATTAC | 5187 | RD | AGGGAC | | | | |
| 105 | AKEG | 4877 | GCCAAGGAAGGA | 5049 | SGY | n/a | AGCGGATAT | n/a | RE | AGGGAG | | | | |
| 106 | AKDG | 4878 | GCCAAGGACGGA | 5050 | YYDSSGYY | 4165 | TACTATGATAGTAGTGGGTACTAT | 5188 | RF | AGATTC | | | | |
| 107 | AKGG | 4879 | GCCAAGGGCGGA | 5051 | YYYDSSGY | 4164 | TACTACTATGACAGCTCAGGGTAT | 5189 | RG | AGGGGA | | | | |
| 108 | AKR | n/a | GCCAAGAGA | 5052 | YYDSSGYYY | 4163 | TATTACGACAGCAGTGGCTACTACTAT | 5190 | RH | AGGCAT | | | | |
| 109 | AKER | 4880 | GCCAAGGAAAGA | 5052 | YYYDSSGYY | 4162 | TACTACTACGATAGCTCTGGATACTAT | 5191 | RL | AGATTA | | | | |
| 110 | AKDR | 4881 | GCCAAGGACAGA | 5053 | YYYDSSGYYY | 4161 | TATTATTACGATTCCAGTGTTATTA TTAT | 5192 | RM | AGGATG | | | | |
| 111 | AKGR | 4882 | GCCAAGGGCAGA | 5054 | YDS | n/a | TACGACTCC | n/a | RP | AGCCCA | | | | |
| 112 | AKS | n/a | GCCAAGTCT | n/a | YYD | n/a | TACTATGAC | n/a | RR | CGTAGA | | | | |
| 113 | AKES | 4883 | GCCAAGGAATCT | 5055 | DSSG | 4185 | GACTCATCCGGT | 5193 | RS | AGAAGT | | | | |
| 114 | AKDS | 4884 | GCCAAGGATTCT | 5056 | GYYY | 4188 | GGTTACTATAC | 5194 | RV | AGAGTG | | | | |
| 115 | AKGS | 4885 | GCCAAGGGATCT | 5057 | SGYY | 4187 | AGCGGCTACTAT | 5195 | RY | AGATAT | | | | |
| 116 | AKP | n/a | GCCAAGCCT | n/a | DS | n/a | GACTCT | n/a | SA | TCAGCC | | | | |
| 117 | AKDP | 4886 | GCCAAGGATCCT | 5058 | RFLEW | 4231 | AGATTTTTGGAGTGG | 5196 | SD | TCAGAC | | | | |
| 118 | AKGP | 4887 | GCCAAGGGTCCT | 5059 | EWL | n/a | GAATGGCTT | n/a | SE | TCCGAG | | | | |
| 119 | AKL | n/a | GCCAAGTTG | n/a | RF | n/a | AGATTC | n/a | SF | TCATTC | | | | |
| 120 | AKDL | 4888 | GCCAAGGACTTG | 5060 | YYDFWSGYYT | 4242 | TACTATGATTTTTGGAGTGGATATTA TACC | 5197 | SG | AGCGGA | | | | |
| 121 | AKGL | 4889 | GCCAAGGGGTTG | 5061 | YDFWSG | 4253 | TATGATTTTTGGTCTCGT | 5198 | SH | AGTCAC | | | | |
| 122 | AKA | n/a | GCCAAGCT | n/a | DFWSGY | 4254 | GATTTTTGGAGCGGCTAT | 5199 | SI | TCTATC | | | | |
| 123 | AKEA | 4890 | GCCAAGGAAGCT | 5062 | FWSGY | 4260 | TTTTGGAGCGGGTAT | 5200 | SK | AGTAAA | | | | |
| 124 | AKDA | 4891 | GCCAAGGACGCT | 5063 | YDFWSGYY | 4243 | TACTACGACTTCTGGAGCGGGTATTAC | 5201 | SL | TCCTTG | | | | |
| 125 | AKGA | 4892 | GCCAAGGGCGCT | 5064 | YYDFWSGY | 4245 | TACTACGATTTTGGTCTGGATAT | 5202 | SP | AGCCCA | | | | |

TABLE 25-continued

Segments used in Exemplary Library Design 3 (ELD-3). The sequences collectively form a theoretical segment pool that comprises individual theoretical segment pools of TN1, DH, N2, and H3-JH segments.

| TN1 Segment No. | TN1 (plus AR or AK)[1] | SEQ ID NO | TN1 Nucleotides (plus AR or AK)[1] | SEQ ID NO | DH | SEQ ID NO | DH Nucleotides | SEQ ID NO | N2 | SEQ ID NO | N2 Nucleotides | SEQ ID NO H3-JH | SEQ ID NO H3-JH Nucleotides |
|---|---|---|---|---|---|---|---|---|---|---|---|---|---|
| 126 | AKT | n/a | GCCAAGACT | n/a | YDFWSGYY | 4246 | TATGACTTTTGGAGTGGTTACTAC | 5203 | SQ | AGCCAA | | |
| 127 | AKET | 4893 | GCCAAGGAAACT | 5065 | YYDFWSG | 4248 | TACTACGATTTCTGGTCAGGC | 5204 | SR | TCAAGA | | |
| 128 | AKDT | 4894 | GCCAAGGATACT | 5066 | YDFWSG | 4249 | TATGACTTCTGGAGTGGTTAC | 5205 | SS | TCCTCA | | |
| 129 | AKGT | 4895 | GCCAAGGGAACT | 5067 | DFWSGYY | 4250 | GACTTCTGGTCAGGATACTAC | 5206 | ST | AGTACA | | |
| 130 | AKV | n/a | GCCAAGGTG | n/a | VLRYF | 4307 | GTGTTGAGGTACTTC | 5207 | SV | TCAGTA | | |
| 131 | AKEV | 4896 | GCCAAGGAAGTG | 5068 | LRYFD | 4308 | TTAAGATACTTTGAT | 5208 | SW | TCATGG | | |
| 132 | AKDV | 4897 | GCCAAGGACGTG | 5069 | RYFDW | 4309 | AGATACTTTGATTGG | 5209 | SY | TCTTAC | | |
| 133 | AKGV | 4898 | GCCAAGGGCGTG | 5070 | VLRY | 4312 | GTGTTGAGGTAT | 5210 | TA | ACCGCC | | |
| 134 | AKEGG | 4899 | GCCAAGGAGGAGGA | 5071 | LRYF | 4313 | TTGAGATATTTC | 5211 | TG | ACTGGC | | |
| 135 | AKDGG | 4900 | GCCAAGGACGGTGGA | 5072 | RYFD | 4314 | AGATACTTTGAT | 5212 | TP | ACACCA | | |
| 136 | AKGGG | 4901 | GCCAAGGGAGGAGGA | 5073 | VLRYFDWL | 4298 | GTCTTAAGGTACTTCGATTGGCTT | 5213 | TR | ACAAGA | | |
| 137 | AKDGR | 4902 | GCCAAGGACGCGTAGA | 5074 | LRY | n/a | TTAAGATAC | n/a | TS | ACATCT | | |
| 138 | AKGGS | 4903 | GCCAAGGGAGGTTCT | 5075 | RYF | n/a | AGATACTTC | n/a | TT | ACTACT | | |
| 139 | AKGGP | 4904 | GCCAAGGAGGAGTCCT | 5076 | RY | n/a | AGATAT | n/a | TV | ACAGTT | | |
| 140 | AKGGV | 4905 | GCCAAGGAGGAGCGTGTG | 5077 | FD | n/a | TTCGAT | n/a | TW | ACTTGG | | |
| 141 | AKDGT | 4906 | GCCAAGGATGGCACT | 5078 | DW | n/a | GATTGG | n/a | TY | ACTTAT | | |
| 142 | AKGGT | 4907 | GCCAAGGAGGCACT | 5079 | VLRYFDW | 4300 | GTCTTAAGATACTTTGATTGG | 5214 | VA | GTAGCC | | |
| 143 | AKEGV | 4908 | GCCAAGGAAGAGTG | 5080 | VLRYFD | 4303 | GTGTTGAGGTACTTTGAC | 5215 | VD | GTCGAC | | |
| 144 | AKGGV | 4909 | GCCAAGGGCGTGTG | 5081 | LRYFDW | 4304 | TTAAGATACTTCGATTGG | 5216 | VG | GTTGGA | | |
| 145 | AKRG | 4910 | GCCAAGAGAGGA | 5082 | RYFDWL | 4305 | AGATATTTCGACTGGCTT | 5217 | VL | GTCTTG | | |
| 146 | AKERG | 4911 | GCCAAGGAGAGAGGA | 5083 | YDILTGYY | 4322 | TATGACATATTGACTGGCTACTAC | 5218 | VP | GTTCCT | | |
| 147 | AKDRG | 4912 | GCCAAGGATAGGGGA | 5084 | YDILTGY | 4325 | TATGATATATTAACTGGGTAC | 5219 | VR | GTGAGA | | |

TABLE 25-continued

Segments used in Exemplary Library Design 3 (ELD-3). The sequences collectively form a theoretical segment pool that comprises individual theoretical segment pools of TN1, DH, N2, and H3-JH segments.

| TN1 Seg- ment No. | TN1 (plus AR or AK)[1] | SEQ ID NO | TN1 Nucleotides (plus AR or AK)[1] | SEQ ID NO | DH | SEQ ID NO | DH Nucleotides | SEQ ID NO | N2 | N2 Nucleotides | SEQ ID NO | H3-JH | SEQ ID NO H3-JH Nucleotides |
|---|---|---|---|---|---|---|---|---|---|---|---|---|---|
| 148 | AKGRG | 4913 | GCCAAGGGTAGGGGA | 5085 | DILTGYY | 4326 | GATATCTTAACCGGGTATTAT | 5220 | VS | GTTTCA | | | |
| 149 | AKSG | 4914 | GCCAAGTCTGGA | 5086 | DYG | n/a | GATTATGGT | n/a | VT | GTTACC | | | |
| 150 | AKDSG | 4915 | GCCAAGGATAGTGGA | 5087 | GDY | n/a | GGGGACTAC | n/a | VV | GTAGTA | | | |
| 151 | AKDPG | 4916 | GCCAAGGACCCCGGA | 5088 | YGD | n/a | TACGGTGAC | n/a | WG | TGGGGT | | | |
| 152 | AKLG | 4917 | GCCAAGTTAGGA | 5089 | DYGD | n/a | GATTACGGCGAT | 5221 | WS | TGGTCA | | | |
| 153 | AKDLG | 4918 | GCCAAGGATCTTGGA | 5090 | YGDY | n/a | TACGGCGATTAT | 5222 | YA | TACGCT | | | |
| 154 | AKAG | 4919 | GCCAAGGCTGGA | 5091 | DYGDY | n/a | GACTACGGAGATTAT | 5223 | YD | TATGAC | | | |
| 155 | AKVG | 4920 | GCCAAGGTAGGA | 5092 | TTVTT | n/a | ACCACAGTAACCACC | 5224 | YE | TATGAG | | | |
| 156 | AKGVG | 4921 | GCCAAGGGTGTCGGA | 5093 | TTVT | n/a | ACAACTGTGACT | 5225 | YS | TATTCT | | | |
| 157 | AKPR | 4922 | GCCAAGCCTAGA | 5094 | TVTT | n/a | ACAGTAACTACT | 5226 | AAAGCTGCCGCT | | | |
| 158 | AKGPR | 4923 | GCCAAGGGCCCCAGA | 5095 | RW | n/a | AGATGG | n/a | AGM | GCAGGCATG | | | |
| 159 | AKPS | 4924 | GCCAAGCCTTCT | 5096 | VTP | n/a | GTAACTCCT | n/a | DGG | GATGGGGGT | | | |
| 160 | AKDPS | 4925 | GCCAAGGATCCCTCT | 5097 | VD | n/a | GTTGAC | n/a | DGV | GATGGTGTA | | | |
| 161 | AKGPS | 4926 | GCCAAGGGGCCATCT | 5098 | GYSGYD | 4386 | GGCTACTCAGGATACGAC | 5227 | FGG | TTCGGGGGC | | | |
| 162 | AKDPP | 4927 | GCCAAGGATCCACCT | 5099 | YSGYD | 4389 | TATAGCCGGATATGAC | 5228 | GAG | GGAGCTGGA | | | |
| 163 | AKGPP | 4928 | GCCAAGGGGCCCTCCT | 5100 | RD | n/a | AGAGAT | n/a | GGA | GGAGGGGCC | | | |
| 164 | AKPL | 4929 | GCCAAGCCGTTG | 5101 | RDGY | 4410 | AGAGATGGTTAC | 5229 | GGG | GGGGAGGCGGT | | | |
| 165 | AKDPL | 4930 | GCCAAGGACCCTTTG | 5102 | RDG | 4420 | AGAGATGGT | 5230 | GGL | GGAGGCTTA | | | |
| 166 | AKRP | 4931 | GCCAAGAGGCCT | 5103 | DTAM | 4420 | GATACTGCTATG | 5230 | GGR | GGTGGTAGA | | | |
| 167 | AKDRP | 4932 | GCCAAGGACCGTCCT | 5104 | YGY | n/a | TACGGCTAC | n/a | GGS | GGCGGAGC | | | |
| 168 | AKSP | 4933 | GCCAAGAGTCCT | 5105 | YSY | n/a | TATTCTTAC | n/a | GGV | GGTGGGGTA | | | |
| 169 | AKLP | 4934 | GCCAAGCTACCT | 5106 | YSYG | 4433 | TATTCATATGGT | 5231 | GLG | GGATTAGGC | | | |
| 170 | AKAP | 4935 | GCCAAGGCTCCT | 5107 | GYSYG | 4430 | GGATATAGTTATGGC | 5232 | GPG | GGCCCCGGC | | | |

TABLE 25-continued

Segments used in Exemplary Library Design 3 (ELD-3). The sequences collectively form a theoretical segment pool that comprises individual theoretical segment pools of TN1, DH, N2, and H3-JH segments.

| TN1 Segment No. | TN1 (plus AR or AK)[1] | SEQ ID NO TN1 Nucleotides (plus AR or AK)[1] | SEQ ID NO DH | DH Nucleotides | SEQ ID NO N2 | N2 Nucleotides | SEQ ID NO H3-JH | H3-JH Nucleotides |
|---|---|---|---|---|---|---|---|---|
| 171 | AKTP | 4936 GCCAAGACGCCT | 5108 SSS | n/a AGTTCAAGC | n/a GPP | GGACCACCT | | |
| 172 | AKVP | 4937 GCCAAGGTACCT | 5109 YSSSWY | 4437 TACAGTAGTCTTGGTAC | 5233 GRG | GGGAAGGGGC | | |
| 173 | AKVGG | 4938 GCCAAGGTGGGTGGA | 5110 GYSSSWY | 4435 GGCTACAGTTCAAGCTGGTAT | 5234 GSG | GGATCTGGC | | |
| 174 | AKQ | n/a GCAAAACAG | n/a SSW | n/a AGTTCCTGG | n/a GTG | GGAACTGGC | | |
| 175 | AKH | n/a GCCAAACAC | n/a SWY | n/a AGCTGGTAC | n/a GVG | GGAGTAGGT | | |
| 176 | AKDQ | 4939 GCCAAGGATCAG | 5111 SSSW | 4443 AGTAGCTCTTGG | 5235 LGG | TTGGGAGGC | | |
| 177 | AKDH | 4940 GCTAAAGACCAC | 5112 YSSS | 4442 TACAGCAGCTCC | 5236 LGH | TTGGGCCAC | | |
| 178 | AKAR | 4941 GCCAAGGCAAGA | 5113 YSSSW | 4439 TACTCTTCCTCATGG | 5237 PGG | CCTGGCGGC | | |
| 179 | AKAS | 4942 GCCAAGGCATCT | 5114 SW | n/a AGCTGG | n/a PKQ | CCAAAGCAG | | |
| 180 | AKDQG | 4943 GCAAAGGATCAGGGA | 5115 AG | n/a GCTGGT | n/a PKR | CCTAAAAGG | | |
| 181 | AKSR | 4944 GCCAAGAGTAGA | 5116 QQLV | 4455 CAGCAATTGGTT | 5238 PTQ | CCAACTCAG | | |
| 182 | AKDRS | 4945 GCAAAAGACAGTCT | 5117 QQL | n/a CAGCAACTT | n/a RFE | AGTTTGAG | | |
| 183 | AKSL | 4946 GCAAAGAGCTTG | 5118 GWY | n/a GGTTGGTAC | 5239 RGG | AGGGGAGGT | | |
| 184 | AKLH | 4947 GCTAAATTGCAC | 5119 SSGWY | 4461 AGCTCTGGATGGTAC | 5240 RGL | AGGGGATTG | | |
| 185 | AKDLT | 4948 GCCAAGGACTTGACT | 5120 YSSGW | 4460 TATAGTAGCGGATGG | 5241 RGS | AGGGGTAGT | | |
| 186 | AKK | n/a GCTAAAAAG | n/a YSSGWY | 4458 TATAGCAGCGGTTGGTAC | 5242 RPL | AGGCCATTA | | |
| 187 | AKAE | 4949 GCTAAAGCAGAG | 5121 GYSSGWY | 4456 GGTTATTCATCAGGTTGGTAT | 5242 RPY | AGGCCATAT | | |
| 188 | AKDLS | 4950 GCAAAAGACTTGTCT | 5122 SGW | n/a AGTGGTTGG | n/a SAA | TCTGCCGCC | | |
| 189 | AKGD | 4951 GCAAAAGGGGAC | 5123 YSS | n/a TACAGTTCC | n/a SGE | AGCGGGGAG | | |
| 190 | AKRR | 4952 GCAAAAAGGAGA | 5124 SGWY | 4464 AGTGGTTGGTAT | 5243 SGG | TCTGGCGGC | | |
| 191 | AKDK | 4953 GCAAAAGACAAG | 5125 SSGW | 4463 AGTTCCGGTTGG | 5244 SGL | TCAGGGTTA | | |
| 192 | AKVS | 4954 GCCAAGTATCT | 5126 YSSG | 4462 TACTCAAGTGT | 5245 SGW | AGCGGTTGG | | |

TABLE 25-continued

Segments used in Exemplary Library Design 3 (ELD-3). The sequences collectively form a theoretical segment pool that comprises individual theoretical segment pools of TN1, DH, N2, and H3-JH segments.

| TN1 Segment No. | TN1 (plus AR or AK)[1] | SEQ ID NO (plus AR or AK)[1] | TN1 Nucleotides | SEQ ID NO DH | DH | SEQ ID NO DH Nucleotides | DH Nucleotides | SEQ ID NO N2 | N2 | N2 Nucleotides | SEQ ID NO H3-JH | H3-JH Nucleotides |
|---|---|---|---|---|---|---|---|---|---|---|---|---|
| 193 | AKDRL | 4955 | GCAAAAGACAGTTG | 5127 | GW | n/a | GGTTGG | n/a | SGY | AGCGGCTAC | | |
| 194 | AKGQ | 4956 | GCCAAAGGACAG | 5128 | QWLV | 4475 | CAGTGGTTAGTT | 5246 | SRG | TCAAGAGT | | |
| 195 | AKVR | 4957 | GCAAAAGTCAGA | 5129 | EYSS | 4479 | GAGTACTCATCC | 5247 | SSE | TCATCAGAG | | |
| 196 | AKAK | 4958 | GCAAAGGCAAAG | 5130 | SIAARP | 4481 | AGCATAGCAGCAAGGCCT | 5248 | SSW | AGCTCATGG | | |
| 197 | AKGK | 4959 | GCAAAGGGCAAG | 5131 | RP | n/a | CGTCCT | n/a | TGG | ACCGGTGGC | | |
| 198 | AKDIS | 4960 | GCAAAGACATTTCT | 5132 | IAARP | 4483 | ATAGCAGCAAGGCCT | 5249 | VGR | GTTGGCAGA | | |
| 199 | AKDFT | 4961 | GCTAAAGATTTCACT | 5133 | AARP | 4486 | GCCGCAAGACCT | 5250 | VQG | GTGCAAGGA | | |
| 200 | AKQG | 4962 | GCCAAGCAAGGA | 5134 | ARP | n/a | GCTAGACCT | n/a | VTA | GTCACAGCT | | |

[1]"AR" and "AK" refer to the last two C-terminal amino acids of the heavy chain chassis used in the current example. They are not part of the TN1 segment.

TABLE 26

Theoretical segment pool of 300 TN1 segments (plus AR/AK; which is not part of TN1) used in the library of Example 12.

| Peptide (plus AR or AK)[1] | SEQ ID NO | Nucleotide (plus AR or AK)[1] | SEQ ID NO | In ELD-3? |
|---|---|---|---|---|
| AR | n/a | GCCAGA | n/a | YES |
| AK | n/a | GCCAAG | n/a | YES |
| ARE | n/a | GCCAGAGAG | n/a | YES |
| AKE | n/a | GCCAAGGAG | n/a | YES |
| ARD | n/a | GCCAGAGAC | n/a | YES |
| AKD | n/a | GCCAAGGAC | n/a | YES |
| ARG | n/a | GCCAGAGGA | n/a | YES |
| AKG | n/a | GCCAAGGGA | n/a | YES |
| AREG | 4791 | GCCAGAGAGGGA | 4963 | YES |
| AKEG | 4877 | GCCAAGGAAGGA | 5049 | YES |
| ARDG | 4792 | GCCAGAGACGGA | 4964 | YES |
| AKDG | 4878 | GCCAAGGACGGA | 5050 | YES |
| ARGG | 4793 | GCCAGAGGTGGA | 4965 | YES |
| AKGG | 4879 | GCCAAGGGCGGA | 5051 | YES |
| ARR | n/a | GCCAGGAGA | n/a | YES |
| AKR | n/a | GCCAAGAGA | n/a | YES |
| ARER | 4794 | GCCAGAGAGAGA | 4966 | YES |
| AKER | 4880 | GCCAAGGAAAGA | 5052 | YES |
| ARDR | 4795 | GCCAGAGACAGA | 4967 | YES |
| AKDR | 4881 | GCCAAGGACAGA | 5053 | YES |
| ARGR | 4796 | GCCAGAGGCAGA | 4968 | YES |
| AKGR | 4882 | GCCAAGGGCAGA | 5054 | YES |
| ARS | n/a | GCCAGATCT | n/a | YES |
| AKS | n/a | GCCAAGTCT | n/a | YES |
| ARES | 4797 | GCCAGAGAATCT | 4969 | YES |
| AKES | 4883 | GCCAAGGAATCT | 5055 | YES |
| ARDS | 4798 | GCCAGAGACTCT | 4970 | YES |
| AKDS | 4884 | GCCAAGGATTCT | 5056 | YES |
| ARGS | 4799 | GCCAGAGGTTCT | 4971 | YES |
| AKGS | 4885 | GCCAAGGGATCT | 5057 | YES |
| ARP | n/a | GCCAGACCT | n/a | YES |
| AKP | n/a | GCCAAGCCT | n/a | YES |
| AREP | 5328 | GCCAGAGAGCCT | 5428 | NO |
| AKEP | 5329 | GCCAAGGAGCCT | 5429 | NO |
| ARDP | 4800 | GCCAGAGACCCT | 4972 | YES |
| AKDP | 4886 | GCCAAGGATCCT | 5058 | YES |
| ARGP | 4801 | GCCAGAGGGCCT | 4973 | YES |
| AKGP | 4887 | GCCAAGGGTCCT | 5059 | YES |
| ARL | n/a | GCCAGATTG | n/a | YES |
| AKL | n/a | GCCAAGTTG | n/a | YES |
| AREL | 5330 | GCCAGAGAGTTG | 5430 | NO |
| AKEL | 5331 | GCCAAGGAATTG | 5431 | NO |
| ARDL | 4802 | GCCAGAGACTTG | 4974 | YES |
| AKDL | 4888 | GCCAAGGACTTG | 5060 | YES |
| ARGL | 4803 | GCCAGAGGGTTG | 4975 | YES |
| AKGL | 4889 | GCCAAGGGGTTG | 5061 | YES |
| ARA | n/a | GCCAGAGCT | n/a | YES |
| AKA | n/a | GCCAAGGCT | n/a | YES |
| AREA | 4804 | GCCAGAGAGGCT | 4976 | YES |
| AKEA | 4890 | GCCAAGGAAGCT | 5062 | YES |
| ARDA | 4805 | GCCAGAGATGCT | 4977 | YES |
| AKDA | 4891 | GCCAAGGACGCT | 5063 | YES |
| ARGA | 4806 | GCCAGAGGTGCT | 4978 | YES |
| AKGA | 4892 | GCCAAGGGCGCT | 5064 | YES |
| ART | n/a | GCCAGAACT | n/a | YES |
| AKT | n/a | GCCAAGACT | n/a | YES |
| ARET | 4807 | GCCAGAGAGACT | 4979 | YES |
| AKET | 4893 | GCCAAGGAAACT | 5065 | YES |
| ARDT | 4808 | GCCAGAGATACT | 4980 | YES |
| AKDT | 4894 | GCCAAGGATACT | 5066 | YES |
| ARGT | 4809 | GCCAGAGGCACT | 4981 | YES |
| AKGT | 4895 | GCCAAGGGAACT | 5067 | YES |
| ARV | n/a | GCCAGAGTG | n/a | YES |
| AKV | n/a | GCCAAGGTG | n/a | YES |
| AREV | 4810 | GCCAGAGAGGTG | 4982 | YES |
| AKEV | 4896 | GCCAAGGAAGTG | 5068 | YES |
| ARDV | 4811 | GCCAGAGATGTG | 4983 | YES |
| AKDV | 4897 | GCCAAGGACGTG | 5069 | YES |
| ARGV | 4812 | GCCAGAGGGGTG | 4984 | YES |
| AKGV | 4898 | GCCAAGGGCGTG | 5070 | YES |
| AREGG | 4813 | GCCAGAGAGGGAGGA | 4985 | YES |
| AKEGG | 4899 | GCCAAGGAGGGAGGA | 5071 | YES |

TABLE 26-continued

Theoretical segment pool of 300 TN1 segments (plus AR/AK; which is not part of TN1) used in the library of Example 12.

| Peptide (plus AR or AK)[1] | SEQ ID NO | Nucleotide (plus AR or AK)[1] | SEQ ID NO | In ELD-3? |
|---|---|---|---|---|
| ARDGG | 4814 | GCCAGAGATGGTGGA | 4986 | YES |
| AKDGG | 4900 | GCCAAGGACGGTGGA | 5072 | YES |
| ARGGG | 4815 | GCCAGAGGTGGAGGA | 4987 | YES |
| AKGGG | 4901 | GCCAAGGGAGGAGGA | 5073 | YES |
| AREGR | 5332 | GCCAGAGAAGGGAGA | 5432 | NO |
| AKEGR | 5333 | GCCAAGGAAGGCAGA | 5433 | NO |
| ARDGR | 4816 | GCCAGAGACGGCAGA | 4988 | YES |
| AKDGR | 4902 | GCCAAGGACGGTAGA | 5074 | YES |
| ARGGR | 5334 | GCCAGAGGAGGTAGA | 5434 | NO |
| AKGGR | 5335 | GCCAAGGGAGGTAGA | 5435 | NO |
| AREGS | 5336 | GCCAGAGAAGGATCT | 5436 | NO |
| AKEGS | 5337 | GCCAAGGAAGGATCT | 5437 | NO |
| ARDGS | 5338 | GCCAGAGACGGATCT | 5438 | NO |
| AKDGS | 5339 | GCCAAGGATGGTTCT | 5439 | NO |
| ARGGS | 4817 | GCCAGAGGCGGTTCT | 4989 | YES |
| AKGGS | 4903 | GCCAAGGGAGGTTCT | 5075 | YES |
| AREGP | 5340 | GCCAGAGAAGGTCCT | 5440 | NO |
| AKEGP | 5341 | GCCAAGGAGGGGCCT | 5441 | NO |
| ARDGP | 5342 | GCCAGAGACGGTCCT | 5442 | NO |
| AKDGP | 5343 | GCCAAGGACGGTCCT | 5443 | NO |
| ARGGP | 4818 | GCCAGAGGTGGGCCT | 4990 | YES |
| AKGGP | 4904 | GCCAAGGGAGGTCCT | 5076 | YES |
| AREGL | 5344 | GCCAGAGAGGGCTTG | 5444 | NO |
| AKEGL | 5345 | GCCAAGGAAGGGTTG | 5445 | NO |
| ARDGL | 5346 | GCCAGAGATGGGTTG | 5446 | NO |
| AKDGL | 5347 | GCCAAGGACGGTTTG | 5447 | NO |
| ARGGL | 5348 | GCCAGAGGTGGATTG | 5448 | NO |
| AKGGL | 5349 | GCCAAGGGAGGGTTG | 5449 | NO |
| AREGA | 5350 | GCCAGAGAAGGAGCT | 5450 | NO |
| AKEGA | 5351 | GCCAAGGAGGGAGCT | 5451 | NO |
| ARDGA | 5352 | GCCAGAGATGGCGCT | 5452 | NO |
| AKDGA | 5353 | GCCAAGGATGGAGCT | 5453 | NO |
| ARGGA | 4819 | GCCAGAGGAGGTGCT | 4991 | YES |
| AKGGA | 4905 | GCCAAGGGAGGCGCT | 5077 | YES |
| ARDGT | 4820 | GCCAGAGACGGTACT | 4992 | YES |
| AKDGT | 4906 | GCCAAGGATGGCACT | 5078 | YES |
| ARGGT | 4821 | GCCAGAGGTGGAACT | 4993 | YES |
| AKGGT | 4907 | GCCAAGGGAGGCACT | 5079 | YES |
| AREGV | 4822 | GCCAGAGAGGGAGTG | 4994 | YES |
| AKEGV | 4908 | GCCAAGGAAGGAGTG | 5080 | YES |
| ARDGV | 5354 | GCCAGAGATGGTGTG | 5454 | NO |
| AKDGV | 5355 | GCCAAGGATGGTGTG | 5455 | NO |
| ARGGV | 4823 | GCCAGAGGTGGCGTG | 4995 | YES |
| AKGGV | 4909 | GCCAAGGGCGGTGTG | 5081 | YES |
| ARRG | 4824 | GCCAGAAGAGGA | 4996 | YES |
| AKRG | 4910 | GCCAAGAGAGGA | 5082 | YES |
| ARERG | 4825 | GCCAGAGAGCGTGGA | 4997 | YES |
| AKERG | 4911 | GCCAAGGAGAGAGGA | 5083 | YES |
| ARDRG | 4826 | GCCAGAGATCGTGGA | 4998 | YES |
| AKDRG | 4912 | GCCAAGGATAGGGGA | 5084 | YES |
| ARGRG | 4827 | GCCAGAGGCAGGGGA | 4999 | YES |
| AKGRG | 4913 | GCCAAGGGTAGGGGA | 5085 | YES |
| ARSG | 4828 | GCCAGATCAGGA | 5000 | YES |
| AKSG | 4914 | GCCAAGTCTGGA | 5086 | YES |
| ARESG | 5356 | GCCAGAGAGTCTGGA | 5456 | NO |
| AKESG | 5357 | GCCAAGGAAAGTGGA | 5457 | NO |
| ARDSG | 4829 | GCCAGAGACTCAGGA | 5001 | YES |
| AKDSG | 4915 | GCCAAGGATAGTGGA | 5087 | YES |
| ARGSG | 5358 | GCCAGAGGCTCTGGA | 5458 | NO |
| AKGSG | 5359 | GCCAAGGGGTCTGGA | 5459 | NO |
| ARPG | 5360 | GCCAGACCAGGA | 5460 | NO |
| AKPG | 5361 | GCCAAGCCCGGA | 5461 | NO |
| ARDPG | 4830 | GCCAGAGATCCAGGA | 5002 | YES |
| AKDPG | 4916 | GCCAAGGACCCCGGA | 5088 | YES |
| ARGPG | 5362 | GCCAGAGGACCTGGA | 5462 | NO |
| AKGPG | 5363 | GCCAAGGGGCCTGGA | 5463 | NO |
| ARLG | 4831 | GCCAGATTGGGA | 5003 | YES |
| AKLG | 4917 | GCCAAGTTAGGA | 5089 | YES |
| ARDLG | 4832 | GCCAGAGACTTGGGA | 5004 | YES |
| AKDLG | 4918 | GCCAAGGATCTTGGA | 5090 | YES |
| ARGLG | 5364 | GCCAGAGGACTAGGA | 5464 | NO |
| AKGLG | 5365 | GCCAAGGGTTTGGGA | 5465 | NO |

TABLE 26-continued

Theoretical segment pool of 300 TN1 segments (plus AR/AK; which is not part of TN1) used in the library of Example 12.

| Peptide (plus AR or AK)[1] | SEQ ID NO | Nucleotide (plus AR or AK)[1] | SEQ ID NO | In ELD-3? |
|---|---|---|---|---|
| ARAG | 4833 | GCCAGAGCTGGA | 5005 | YES |
| AKAG | 4919 | GCCAAGGCTGGA | 5091 | YES |
| AREAG | 5366 | GCCAGAGAAGCCGGA | 5466 | NO |
| AKEAG | 5367 | GCCAAGGAGGCTGGA | 5467 | NO |
| ARDAG | 5368 | GCCAGAGACGCAGGA | 5468 | NO |
| AKDAG | 5369 | GCCAAGGATGCCGGA | 5469 | NO |
| ARGAG | 5370 | GCCAGAGGTGCCGGA | 5470 | NO |
| AKGAG | 5371 | GCCAAGGGAGCAGGA | 5471 | NO |
| ARTG | 5372 | GCCAGAACTGGA | 5472 | NO |
| AKTG | 5373 | GCCAAGACCGGA | 5473 | NO |
| ARDTG | 5374 | GCCAGAGACACGGGA | 5474 | NO |
| AKDTG | 5375 | GCCAAGGATACGGGA | 5475 | NO |
| ARVG | 4834 | GCCAGAGTGGGA | 5006 | YES |
| AKVG | 4920 | GCCAAGGTAGGA | 5092 | YES |
| AREVG | 5376 | GCCAGAGAAGTCGGA | 5476 | NO |
| AKEVG | 5377 | GCCAAGGAGGTAGGA | 5477 | NO |
| ARDVG | 5378 | GCCAGAGATGTAGGA | 5478 | NO |
| AKDVG | 5379 | GCCAAGGACGTAGGA | 5479 | NO |
| ARGVG | 4835 | GCCAGAGGCGTAGGA | 5007 | YES |
| AKGVG | 4921 | GCCAAGGGTGTCGGA | 5093 | YES |
| ARPR | 4836 | GCCAGACCCAGA | 5008 | YES |
| AKPR | 4922 | GCCAAGCCTAGA | 5094 | YES |
| ARDPR | 5380 | GCCAGAGATCCAAGA | 5480 | NO |
| AKDPR | 5381 | GCCAAGGATCCTAGA | 5481 | NO |
| ARGPR | 4837 | GCCAGAGGACCAAGA | 5009 | YES |
| AKGPR | 4923 | GCCAAGGGCCCCAGA | 5095 | YES |
| ARPS | 4838 | GCCAGACCATCT | 5010 | YES |
| AKPS | 4924 | GCCAAGCCTTCT | 5096 | YES |
| ARDPS | 4839 | GCCAGAGATCCCTCT | 5011 | YES |
| AKDPS | 4925 | GCCAAGGATCCCTCT | 5097 | YES |
| ARGPS | 4840 | GCAAGAGGACCTTCT | 5012 | YES |
| AKGPS | 4926 | GCCAAAGGGCCATCT | 5098 | YES |
| ARPP | 5382 | GCCAGACCACCT | 5482 | NO |
| AKPP | 5383 | GCCAAGCCACCT | 5483 | NO |
| ARDPP | 4841 | GCCAGAGACCCACCT | 5013 | YES |
| AKDPP | 4927 | GCCAAGGATCCACCT | 5099 | YES |
| ARGPP | 4842 | GCCAGAGGACCGCCT | 5014 | YES |
| AKGPP | 4928 | GCCAAGGGCCCTCCT | 5100 | YES |
| ARPL | 4843 | GCCAGACCGTTG | 5015 | YES |
| AKPL | 4929 | GCCAAGCCGTTG | 5101 | YES |
| ARDPL | 4844 | GCCAGAGATCCTTTG | 5016 | YES |
| AKDPL | 4930 | GCCAAGGACCCTTTG | 5102 | YES |
| ARGPL | 5384 | GCCAGAGGTCCCTTG | 5484 | NO |
| AKGPL | 5385 | GCCAAGGGGCCGTTG | 5485 | NO |
| ARPA | 5386 | GCCAGACCAGCT | 5486 | NO |
| AKPA | 5387 | GCCAAGCCGGCT | 5487 | NO |
| ARDPA | 5388 | GCCAGAGATCCCGCT | 5488 | NO |
| AKDPA | 5389 | GCCAAGGACCCCGCT | 5489 | NO |
| ARPT | 5390 | GCCAGACCTACT | 5490 | NO |
| AKPT | 5391 | GCCAAGCCTACT | 5491 | NO |
| ARDPT | 5392 | GCCAGAGATCCGACT | 5492 | NO |
| AKDPT | 5393 | GCCAAGGACCCTACT | 5493 | NO |
| ARGPT | 5394 | GCCAGAGGACCCACT | 5494 | NO |
| AKGPT | 5395 | GCCAAGGGGCCCACT | 5495 | NO |
| ARPV | 5396 | GCCAGACCGGTG | 5496 | NO |
| AKPV | 5397 | GCCAAGCCAGTG | 5497 | NO |
| ARDPV | 5398 | GCCAGAGATCCGGTG | 5498 | NO |
| AKDPV | 5399 | GCCAAGGACCCTGTG | 5499 | NO |
| ARRP | 4845 | GCCAGAAGGCCT | 5017 | YES |
| AKRP | 4931 | GCCAAGAGGCCT | 5103 | YES |
| ARDRP | 4846 | GCCAGAGACCGTCCT | 5018 | YES |
| AKDRP | 4932 | GCCAAGGACCGTCCT | 5104 | YES |
| ARGRP | 5400 | GCCAGAGGAAGGCCT | 5500 | NO |
| AKGRP | 5401 | GCCAAGGGCCGTCCT | 5501 | NO |
| ARSP | 4847 | GCCAGATCACCT | 5019 | YES |
| AKSP | 4933 | GCCAAGAGTCCT | 5105 | YES |
| ARDSP | 5402 | GCCAGAGACTCTCCT | 5502 | NO |
| AKDSP | 5403 | GCCAAGGACTCCCCT | 5503 | NO |
| ARGSP | 5404 | GCCAGAGGTTCCCCT | 5504 | NO |
| AKGSP | 5405 | GCCAAGGGTTCACCT | 5505 | NO |
| ARLP | 4848 | GCCAGACTTCCT | 5020 | YES |
| AKLP | 4934 | GCCAAGCTACCT | 5106 | YES |

TABLE 26-continued

Theoretical segment pool of 300 TN1 segments
(plus AR/AK; which is not part of TN1)
used in the library of Example 12.

| Peptide (plus AR or AK)[1] | SEQ ID NO | Nucleotide (plus AR or AK)[1] | SEQ ID NO | In ELD-3? |
|---|---|---|---|---|
| ARDLP | 5406 | GCCAGAGATCTTCCT | 5506 | NO |
| AKDLP | 5407 | GCCAAGGATCTACCT | 5507 | NO |
| ARAP | 4849 | GCCAGAGCCCCT | 5021 | YES |
| AKAP | 4935 | GCCAAGGCTCCT | 5107 | YES |
| ARDAP | 5408 | GCCAGAGATGCTCCT | 5508 | NO |
| AKDAP | 5409 | GCCAAGGATGCTCCT | 5509 | NO |
| ARGAP | 5410 | GCCAGAGGGGCCCCT | 5510 | NO |
| AKGAP | 5411 | GCCAAGGGTGCCCCT | 5511 | NO |
| ARTP | 4850 | GCCAGAACTCCT | 5022 | YES |
| AKTP | 4936 | GCCAAGACGCCT | 5108 | YES |
| ARDTP | 5412 | GCCAGAGATACCCCT | 5512 | NO |
| AKDTP | 5413 | GCCAAGGACACGCCT | 5513 | NO |
| ARVP | 4851 | GCCAGAGTCCCT | 5023 | YES |
| AKVP | 4937 | GCCAAGGTACCT | 5109 | YES |
| ARAGG | 5414 | GCCAGAGCTGGCGGA | 5514 | NO |
| AKAGG | 5415 | GCCAAGGCCGGTGGA | 5515 | NO |
| ARDGGG | 5416 | GCCAGAGATGGTGGCGGA | 5516 | NO |
| AKDGGG | 5417 | GCCAAGGACGGCGGTGGA | 5517 | NO |
| ARLGG | 5418 | GCCAGATTGGGCGGA | 5518 | NO |
| AKLGG | 5419 | GCCAAGCTAGGCGGA | 5519 | NO |
| ARDLGG | 5420 | GCCAGAGATTTGGGTGGA | 5520 | NO |
| AKDLGG | 5421 | GCCAAGGATTTGGGTGGA | 5521 | NO |
| ARRGG | 5422 | GCCAGAAGAGGTGGA | 5522 | NO |
| AKRGG | 5423 | GCCAAGAGAGGAGGA | 5523 | NO |
| ARDRGG | 5424 | GCCAGAGACCGTGGCGGA | 5524 | NO |
| AKDRGG | 5425 | GCCAAGGACAGAGGTGGA | 5525 | NO |
| ARSGG | 5426 | GCCAGATCAGGCGGA | 5526 | NO |
| AKSGG | 5427 | GCCAAGTCCGGTGGA | 5527 | NO |
| ARVGG | 4852 | GCCAGAGTTGGAGGA | 5024 | YES |
| AKVGG | 4938 | GCCAAGGTGGGTGGA | 5110 | YES |
| ARQ | n/a | GCCAAGACAG | n/a | YES |
| AKQ | n/a | GCCAAAACAG | n/a | YES |
| ARH | n/a | GCCAGACAC | n/a | YES |
| AKH | n/a | GCCAAACAC | n/a | YES |
| ARDQ | 4853 | GCCAGGGACCAG | 5025 | YES |
| AKDQ | 4939 | GCCAAGGATCAG | 5111 | YES |
| ARDH | 4854 | GCAAGAGACCAC | 5026 | YES |
| AKDH | 4940 | GCTAAAGACCAC | 5112 | YES |
| ARAR | 4855 | GCAAGGGCTAGA | 5027 | YES |
| AKAR | 4941 | GCCAAGGCAAGA | 5113 | YES |
| ARAS | 4856 | GCTAGGGCATCT | 5028 | YES |
| AKAS | 4942 | GCCAAGGCATCT | 5114 | YES |
| ARDQG | 4857 | GCTAGGGATCAGGGA | 5029 | YES |
| AKDQG | 4943 | GCAAAGGATCAGGGA | 5115 | YES |
| ARSR | 4858 | GCTAGATCAAGA | 5030 | YES |
| AKSR | 4944 | GCCAAGAGTAGA | 5116 | YES |
| ARDRS | 4859 | GCCAGGGACAGGTCT | 5031 | YES |
| AKDRS | 4945 | GCAAAAGACAGGTCT | 5117 | YES |
| ARSL | 4860 | GCTAGATCTTTG | 5032 | YES |
| AKSL | 4946 | GCAAAGAGCTTG | 5118 | YES |
| ARLH | 4861 | GCTAGGTTGCAC | 5033 | YES |
| AKLH | 4947 | GCTAAATTGCAC | 5119 | YES |
| ARDLT | 4862 | GCCAGGGATTTGACT | 5034 | YES |
| AKDLT | 4948 | GCCAAGGACTTGACT | 5120 | YES |
| ARK | n/a | GCCAGAAAG | n/a | YES |
| AKK | n/a | GCTAAAAAG | n/a | YES |
| ARAE | 4863 | GCAAGAGCCGAG | 5035 | YES |
| AKAE | 4949 | GCTAAAGCAGAG | 5121 | YES |
| ARDLS | 4864 | GCAAGGGATTTGTCT | 5036 | YES |
| AKDLS | 4950 | GCAAAAGACTTGTCT | 5122 | YES |
| ARGD | 4865 | GCTAGAGGGAC | 5037 | YES |
| AKGD | 4951 | GCAAAAGGGGAC | 5123 | YES |
| ARRR | 4866 | GCTAGGAGGAGA | 5038 | YES |
| AKRR | 4952 | GCAAAAAGGAGA | 5124 | YES |
| ARDK | 4867 | GCTAGAGATAAG | 5039 | YES |
| AKDK | 4953 | GCAAAGACAAG | 5125 | YES |
| ARVS | 4868 | GCTAGAGTATCT | 5040 | YES |
| AKVS | 4954 | GCCAAAGTATCT | 5126 | YES |
| ARDRL | 4869 | GCCAGAGACAGGTTG | 5041 | YES |
| AKDRL | 4955 | GCAAAAGACAGGTTG | 5127 | YES |
| ARGQ | 4870 | GCTAGGGGCCAG | 5042 | YES |
| AKGQ | 4956 | GCCAAAGGACAG | 5128 | YES |

TABLE 26-continued

Theoretical segment pool of 300 TN1 segments (plus AR/AK; which is not part of TN1) used in the library of Example 12.

| Peptide (plus AR or AK)[1] | SEQ ID NO | Nucleotide (plus AR or AK)[1] | SEQ ID NO | In ELD-3? |
|---|---|---|---|---|
| ARVR | 4871 | GCCAGGGTCAGA | 5043 | YES |
| AKVR | 4957 | GCAAAAGTCAGA | 5129 | YES |
| ARAK | 4872 | GCTAGGGCTAAG | 5044 | YES |
| AKAK | 4958 | GCAAAGGCAAAG | 5130 | YES |
| ARGK | 4873 | GCCAGGGGTAAG | 5045 | YES |
| AKGK | 4959 | GCAAAGGGCAAG | 5131 | YES |
| ARDIS | 4874 | GCAAGGGATATTTCT | 5046 | YES |
| AKDIS | 4960 | GCAAAGGACATTTCT | 5132 | YES |
| ARDFT | 4875 | GCTAGGGATTTCACT | 5047 | YES |
| AKDFT | 4961 | GCTAAAGATTTCACT | 5133 | YES |
| ARQG | 4876 | GCCAGGCAGGGA | 5048 | YES |
| AKQG | 4962 | GCCAAGCAAGGA | 5134 | YES |

[1]"AR" and "AK" refer to the last two C-terminal amino acids of the heavy chain chassis used in the current example. They are not part of the TN1 segment.

TABLE 27

Theoretical segment pool of degenerate oligonucleotide sequences encoding DH segments of Example 13.

| Name | Degenerate Oligo | Peptide Length | SEQ ID NO |
|---|---|---|---|
| DH_001 | KHTGAK | 2 | n/a |
| DH_002 | KHTKGG | 2 | n/a |
| DH_003 | KHTCMT | 2 | n/a |
| DH_004 | KHTMCT | 2 | n/a |
| DH_005 | GVCWSG | 2 | n/a |
| DH_006 | SVCYAT | 2 | n/a |
| DH_007 | BYCSAG | 2 | n/a |
| DH_008 | SBAMAG | 2 | n/a |
| DH_009 | VSCMAA | 2 | n/a |
| DH_010 | GRABYT | 2 | n/a |
| DH_011 | GRAKBG | 2 | n/a |
| DH_012 | RDAGAK | 2 | n/a |
| DH_013 | RDAGRT | 2 | n/a |
| DH_014 | YHTSAC | 2 | n/a |
| DH_015 | YHTKAC | 2 | n/a |
| DH_016 | YHTMCG | 2 | n/a |
| DH_017 | MHAGAW | 2 | n/a |
| DH_018 | MHAGRT | 2 | n/a |
| DH_019 | MHAMCT | 2 | n/a |
| DH_020 | MBCYAT | 2 | n/a |
| DH_021 | CVACNG | 2 | n/a |
| DH_022 | MSCAHG | 2 | n/a |
| DH_023 | CRGKBG | 2 | n/a |
| DH_024 | WSGHCT | 2 | n/a |
| DH_025 | WGGKHT | 2 | n/a |
| DH_026 | BGGSAK | 2 | n/a |
| DH_027 | BWCAMA | 2 | n/a |
| DH_028 | BHCTGG | 2 | n/a |
| DH_029 | TGGVBT | 2 | n/a |
| DH_030 | BHCAGT | 2 | n/a |
| DH_031 | SRTATT | 2 | n/a |
| DH_032 | ACABHT | 2 | n/a |
| DH_033 | SVCGCT | 2 | n/a |
| DH_034 | ATGSVT | 2 | n/a |
| DH_035 | SWGAGG | 2 | n/a |
| DH_036 | GTAGCAVBT | 3 | n/a |
| DH_037 | DBGSWACTT | 3 | n/a |
| DH_038 | VNCBCAGGT | 3 | n/a |
| DH_039 | VNCDCATAT | 3 | n/a |
| DH_040 | VHAKKGTTG | 3 | n/a |
| DH_041 | CCAGCABHT | 3 | n/a |
| DH_042 | VHASRACTT | 3 | n/a |
| DH_043 | BHCAGCRST | 3 | n/a |
| DH_044 | BHCGGAKMT | 3 | n/a |
| DH_045 | BHCGGAGDT | 3 | n/a |
| DH_046 | BHCAGCKMT | 3 | n/a |
| DH_047 | NHCCRACTT | 3 | n/a |
| DH_048 | NHCAGCKGG | 3 | n/a |
| DH_049 | BHCGGAKSG | 3 | n/a |
| DH_050 | VBCGGAGNT | 3 | n/a |
| DH_051 | NHCAGCGVT | 3 | n/a |
| DH_052 | NHCTACGVT | 3 | n/a |
| DH_053 | NHCAGCGVG | 3 | n/a |
| DH_054 | VHATGGSYG | 3 | n/a |

TABLE 27-continued

Theoretical segment pool of degenerate oligonucleotide sequences encoding DH segments of Example 13.

| Name | Degenerate Oligo | Peptide Length | SEQ ID NO |
|---|---|---|---|
| DH_055 | VNCGHCTAT | 3 | n/a |
| DH_056 | GGTRNACTT | 3 | n/a |
| DH_057 | NHCABAGGT | 3 | n/a |
| DH_058 | VHAGCAGNT | 3 | n/a |
| DH_059 | DBGKYCGGT | 3 | n/a |
| DH_060 | BHCGGARKT | 3 | n/a |
| DH_061 | NHCGTAGVT | 3 | n/a |
| DH_062 | VNTTHCTAT | 3 | n/a |
| DH_063 | GTAGTABHT | 3 | n/a |
| DH_064 | VBCGNCCTT | 3 | n/a |
| DH_065 | BHCGGAGNG | 3 | n/a |
| DH_066 | VNCGHCGGT | 3 | n/a |
| DH_067 | AGGBHCGGT | 3 | n/a |
| DH_068 | VNCTBGTAT | 3 | n/a |
| DH_069 | VNCTBGCTT | 3 | n/a |
| DH_070 | NHCKACTAT | 3 | n/a |
| DH_071 | CTARNACTT | 3 | n/a |
| DH_072 | NHCBCAGGT | 3 | n/a |
| DH_073 | NHCTACBAT | 3 | n/a |
| DH_074 | BHCACAGCCAKS | 4 | 5528 |
| DH_075 | VHGGBAGCAACT | 4 | 5529 |
| DH_076 | DBGTTCGGAGNG | 4 | 5530 |
| DH_077 | BHCGGAKMCTAT | 4 | 5531 |
| DH_078 | TACAGCAGCVBT | 4 | 5532 |
| DH_079 | VHGGTARSAGGT | 4 | 5533 |
| DH_080 | VBCGACGGATHT | 4 | 5534 |
| DH_081 | NHCTACGGAGVT | 4 | 5535 |
| DH_082 | VHGRYGGCAACT | 4 | 5536 |
| DH_083 | VHATACAGCRST | 4 | 5537 |
| DH_084 | CAGTGGCTABHT | 4 | 5538 |
| DH_085 | VHAGTAGCAGNT | 4 | 5539 |
| DH_086 | VBCACAGTARMG | 4 | 5540 |
| DH_087 | AGCAGCAGCDBG | 4 | 5541 |
| DH_088 | NHCTMCTACGGT | 4 | 5542 |
| DH_089 | BHCAGCTGGTHT | 4 | 5543 |
| DH_090 | VHACAACTAGNT | 4 | 5544 |
| DH_091 | BHCGGAAGCKMT | 4 | 5545 |
| DH_092 | BHCGGATSGTAT | 4 | 5546 |
| DH_093 | NHCAGCGGABGG | 4 | 5547 |
| DH_094 | BHCGGATACKMT | 4 | 5548 |
| DH_095 | VHAGTAACARMG | 4 | 5549 |
| DH_096 | GCAGCAGCAVBT | 4 | 5550 |
| DH_097 | VBCAYATTCGGT | 4 | 5551 |
| DH_098 | GTAGCAGCAVHA | 4 | 5552 |
| DH_099 | NHCTACTACGVT | 4 | 5553 |
| DH_100 | VBCKMCGGATAT | 4 | 5554 |
| DH_101 | VHACAACTAKKG | 4 | 5555 |
| DH_102 | VHGGGARKCGCT | 4 | 5556 |
| DH_103 | VBTBTCGGAGAG | 4 | 5557 |
| DH_104 | BHCTACAGCKMT | 4 | 5558 |
| DH_105 | VHAGTASSAGCT | 4 | 5559 |
| DH_106 | VBTCDAGGAGTT | 4 | 5560 |
| DH_107 | GACAGCAGCDBG | 4 | 5561 |
| DH_108 | VBCGVCTACAGT | 4 | 5562 |
| DH_109 | NHCTACGGAKCT | 4 | 5563 |
| DH_110 | NHCTACTACTHT | 4 | 5564 |
| DH_111 | BHCVGCTACAGT | 4 | 5565 |
| DH_112 | VBCTGGTTCGGT | 4 | 5566 |
| DH_113 | VNCTACTACTHT | 4 | 5567 |
| DH_114 | VHABTCGGAGGT | 4 | 5568 |
| DH_115 | NHCATGGTAAGAGVT | 5 | 5569 |
| DH_116 | NHCTACGGAGACTHT | 5 | 5570 |
| DH_117 | VBCTACAGCTACGNT | 5 | 5571 |
| DH_118 | VNCAGCGGAAGCTHT | 5 | 5572 |
| DH_119 | VBCTTTCTAGAATBG | 5 | 5573 |
| DH_120 | BHCGGAAGCTACKMT | 5 | 5574 |
| DH_121 | NHCAGCGGAAGCTHT | 5 | 5575 |
| DH_122 | BHCAGCAGCAGCTBG | 5 | 5576 |
| DH_123 | BHCAGCAGCGGATBG | 5 | 5577 |
| DH_124 | VBCACAGTAACAANA | 5 | 5578 |
| DH_125 | BHCAGCAGCAGCTHT | 5 | 5579 |
| DH_126 | NHCAGCGGATGGTHT | 5 | 5580 |
| DH_127 | NHCAGCGGATACGVT | 5 | 5581 |

TABLE 27-continued

Theoretical segment pool of degenerate oligonucleotide sequences encoding DH segments of Example 13.

| Name | Degenerate Oligo | Peptide Length | SEQ ID NO |
|---|---|---|---|
| DH_128 | NHCTACTACGACABT | 5 | 5582 |
| DH_129 | BHCAGCAGCGGATHT | 5 | 5583 |
| DH_130 | VHAGCAGCAAGACNT | 5 | 5584 |
| DH_131 | VHGTACTACTACGVT | 5 | 5585 |
| DH_132 | VBCACAATGGTACRG | 5 | 5586 |
| DH_133 | NHCATGGTACRAGGT | 5 | 5587 |
| DH_134 | NHCTSGGGAAGCTAT | 5 | 5588 |
| DH_135 | BHCAGCAGCAGCTGGTHT | 6 | 5589 |
| DH_136 | NHCTACTACGACAGCABT | 6 | 5590 |
| DH_137 | VBCTACAGCGGATACGNT | 6 | 5591 |
| DH_138 | BHCAGCAGCGGATGGTHT | 6 | 5592 |
| DH_139 | NHCTACTACGGAAGCGVT | 6 | 5593 |
| DH_140 | BHCAGCAGCGGATACTHT | 6 | 5594 |
| DH_141 | NHCTACGACAGCAGCGVT | 6 | 5595 |
| DH_142 | NHCGACTTCTGGAGCGVT | 6 | 5596 |
| DH_143 | BHCGACAGCAGCGGATHT | 6 | 5597 |
| DH_144 | SNATACTTCGACTGGYYT | 6 | 5598 |
| DH_145 | TGTRGCRGCACAAGCTGT | 6 | 5599 |
| DH_146 | NHCTACTACGGAAGCGVG | 6 | 5600 |
| DH_147 | TGTRGCRGCGGAAGCTGT | 6 | 5601 |
| DH_148 | NHCTTTTGGAGCGGATHT | 6 | 5602 |
| DH_149 | NHCTACTACGACAGCAGCGVT | 7 | 5603 |
| DH_150 | NHCGACATACTAACAGGATHT | 7 | 5604 |
| DH_151 | NHCTACGACTTCTGGAGCGVT | 7 | 5605 |
| DH_152 | BHCTGTAGCAGCACAAGCTGT | 7 | 5606 |
| DH_153 | DBGTACAGCAGCAGCTGGTHT | 7 | 5607 |
| DH_154 | NHCTACGACAGCAGCGGATHT | 7 | 5608 |
| DH_155 | NHCTACTACGGAAGCGGAABT | 7 | 5609 |
| DH_156 | DBGTACAGCAGCGGATGGTHT | 7 | 5610 |
| DH_157 | BHCTGTAGCGGAGGAAGCTGT | 7 | 5611 |
| DH_158 | TGTAGCGGAGGAAGCTGTYHT | 7 | 5612 |
| DH_159 | TGTAGCAGCACAAGCTGTYHT | 7 | 5613 |
| DH_160 | NHCTGTGGAGGAGACTGTTHT | 7 | 5614 |
| DH_161 | NHCGACTTCTGGAGCGGATHT | 7 | 5615 |
| DH_162 | BHCGACAGCAGCGGATACTHT | 7 | 5616 |
| DH_163 | VHATACTGTGGAGGAGACTGT | 7 | 5617 |
| DH_164 | NHCTACTACGACAGCAGCGGATHT | 8 | 5618 |
| DH_165 | NHCTACTACGGAAGCGGAAGCTHT | 8 | 5619 |
| DH_166 | VBCTACTGTAGCAGCACAAGCTGT | 8 | 5620 |
| DH_167 | VBCTACTGTAGCGGAGGAAGCTGT | 8 | 5621 |
| DH_168 | NHCTACGACTTCTGGAGCGGATHT | 8 | 5622 |
| DH_169 | NHCGACATACTAACAGGATACTHT | 8 | 5623 |
| DH_170 | BHCTGTAGCGGAGGAAGCTGTTHT | 8 | 5624 |
| DH_171 | BHCTGTAGCAGCACAAGCTGTTHT | 8 | 5625 |
| DH_172 | VHATACTGTGGAGGAGACTGTTHT | 8 | 5626 |
| DH_173 | NHCTACGACAGCAGCGGATACTHT | 8 | 5627 |
| DH_174 | VNCTACTACGGAAGCGGAAGCTMT | 8 | 5628 |
| DH_175 | NHCGACTTCTGGAGCGGATACTHT | 8 | 5629 |
| DH_176 | VHACTAAGATACTTCGACTGGYWT | 8 | 5630 |
| DH_177 | NHCTACTACGACAGCAGCGGATACTHT | 9 | 5631 |
| DH_178 | VBCTACTGTAGCGGAGGAAGCTGTTHT | 9 | 5632 |
| DH_179 | VBCTACTGTAGCAGCACAAGCTGTTHT | 9 | 5633 |
| DH_180 | NHCTACGACTTCTGGAGCGGATACTHT | 9 | 5634 |
| DH_181 | BHCTGTAGCGGAGGAAGCTGTTACTHT | 9 | 5635 |
| DH_182 | NHCTACTACGACAGCAGCGGATACTACTHT | 10 | 5636 |
| DH_183 | NHCTACGACTACGTATGGGAAGCTACGCATHT | 11 | 5637 |
| DH_184 | NHCTACGACTACGTATGGGAAGCTACGCATACAHA | 12 | 5638 |

TABLE 28

Theoretical segment pool of unique DH polypeptide segments encoded by the degenerate oligonucleotides of Table 27.

| Name | Sequence | Length | SEQ ID NO |
|---|---|---|---|
| PDH_0001 | YE | 2 | n/a |
| PDH_0002 | DD | 2 | n/a |
| PDH_0003 | VD | 2 | n/a |
| PDH_0004 | FD | 2 | n/a |
| PDH_0005 | AE | 2 | n/a |
| PDH_0006 | SD | 2 | n/a |
| PDH_0007 | YD | 2 | n/a |
| PDH_0008 | VE | 2 | n/a |
| PDH_0009 | DE | 2 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0010 | AD | 2 | n/a |
| PDH_0011 | FE | 2 | n/a |
| PDH_0012 | SE | 2 | n/a |
| PDH_0013 | VG | 2 | n/a |
| PDH_0014 | FW | 2 | n/a |
| PDH_0015 | YG | 2 | n/a |
| PDH_0016 | DW | 2 | n/a |
| PDH_0017 | FG | 2 | n/a |
| PDH_0018 | AW | 2 | n/a |
| PDH_0019 | DG | 2 | n/a |
| PDH_0020 | YW | 2 | n/a |
| PDH_0021 | SG | 2 | n/a |
| PDH_0022 | AG | 2 | n/a |
| PDH_0023 | VW | 2 | n/a |
| PDH_0024 | SW | 2 | n/a |
| PDH_0025 | VP | 2 | n/a |
| PDH_0026 | DH | 2 | n/a |
| PDH_0027 | DP | 2 | n/a |
| PDH_0028 | YP | 2 | n/a |
| PDH_0029 | SH | 2 | n/a |
| PDH_0030 | VH | 2 | n/a |
| PDH_0031 | FH | 2 | n/a |
| PDH_0032 | YH | 2 | n/a |
| PDH_0033 | FP | 2 | n/a |
| PDH_0034 | AP | 2 | n/a |
| PDH_0035 | SP | 2 | n/a |
| PDH_0036 | AH | 2 | n/a |
| PDH_0037 | YT | 2 | n/a |
| PDH_0038 | DT | 2 | n/a |
| PDH_0039 | AT | 2 | n/a |
| PDH_0040 | ST | 2 | n/a |
| PDH_0041 | FT | 2 | n/a |
| PDH_0042 | VT | 2 | n/a |
| PDH_0043 | AS | 2 | n/a |
| PDH_0044 | AR | 2 | n/a |
| PDH_0045 | DS | 2 | n/a |
| PDH_0046 | GT | 2 | n/a |
| PDH_0047 | GS | 2 | n/a |
| PDH_0048 | GW | 2 | n/a |
| PDH_0049 | GR | 2 | n/a |
| PDH_0050 | DR | 2 | n/a |
| PDH_0051 | PH | 2 | n/a |
| PDH_0052 | RH | 2 | n/a |
| PDH_0053 | PY | 2 | n/a |
| PDH_0054 | GH | 2 | n/a |
| PDH_0055 | GY | 2 | n/a |
| PDH_0056 | RY | 2 | n/a |
| PDH_0057 | HH | 2 | n/a |
| PDH_0058 | HY | 2 | n/a |
| PDH_0059 | DY | 2 | n/a |
| PDH_0060 | AY | 2 | n/a |
| PDH_0061 | AQ | 2 | n/a |
| PDH_0062 | FQ | 2 | n/a |
| PDH_0063 | LE | 2 | n/a |
| PDH_0064 | PE | 2 | n/a |
| PDH_0065 | LQ | 2 | n/a |
| PDH_0066 | PQ | 2 | n/a |
| PDH_0067 | VQ | 2 | n/a |
| PDH_0068 | SQ | 2 | n/a |
| PDH_0069 | RK | 2 | n/a |
| PDH_0070 | GK | 2 | n/a |
| PDH_0071 | AK | 2 | n/a |
| PDH_0072 | RQ | 2 | n/a |
| PDH_0073 | GQ | 2 | n/a |
| PDH_0074 | LK | 2 | n/a |
| PDH_0075 | VK | 2 | n/a |
| PDH_0076 | PK | 2 | n/a |
| PDH_0077 | SK | 2 | n/a |
| PDH_0078 | TK | 2 | n/a |
| PDH_0079 | TQ | 2 | n/a |
| PDH_0080 | GL | 2 | n/a |
| PDH_0081 | GP | 2 | n/a |
| PDH_0082 | GV | 2 | n/a |
| PDH_0083 | EF | 2 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0084 | GF | 2 | n/a |
| PDH_0085 | EL | 2 | n/a |
| PDH_0086 | EA | 2 | n/a |
| PDH_0087 | ES | 2 | n/a |
| PDH_0088 | EP | 2 | n/a |
| PDH_0089 | GA | 2 | n/a |
| PDH_0090 | EV | 2 | n/a |
| PDH_0091 | GG | 2 | n/a |
| PDH_0092 | EG | 2 | n/a |
| PDH_0093 | EW | 2 | n/a |
| PDH_0094 | IE | 2 | n/a |
| PDH_0095 | RE | 2 | n/a |
| PDH_0096 | KE | 2 | n/a |
| PDH_0097 | GD | 2 | n/a |
| PDH_0098 | ID | 2 | n/a |
| PDH_0099 | RD | 2 | n/a |
| PDH_0100 | EE | 2 | n/a |
| PDH_0101 | GE | 2 | n/a |
| PDH_0102 | KD | 2 | n/a |
| PDH_0103 | ED | 2 | n/a |
| PDH_0104 | IG | 2 | n/a |
| PDH_0105 | RG | 2 | n/a |
| PDH_0106 | KG | 2 | n/a |
| PDH_0107 | LD | 2 | n/a |
| PDH_0108 | LH | 2 | n/a |
| PDH_0109 | PD | 2 | n/a |
| PDH_0110 | HD | 2 | n/a |
| PDH_0111 | SY | 2 | n/a |
| PDH_0112 | FY | 2 | n/a |
| PDH_0113 | YY | 2 | n/a |
| PDH_0114 | LY | 2 | n/a |
| PDH_0115 | LT | 2 | n/a |
| PDH_0116 | HP | 2 | n/a |
| PDH_0117 | HT | 2 | n/a |
| PDH_0118 | LP | 2 | n/a |
| PDH_0119 | PT | 2 | n/a |
| PDH_0120 | PP | 2 | n/a |
| PDH_0121 | TE | 2 | n/a |
| PDH_0122 | QE | 2 | n/a |
| PDH_0123 | TD | 2 | n/a |
| PDH_0124 | QD | 2 | n/a |
| PDH_0125 | PG | 2 | n/a |
| PDH_0126 | LG | 2 | n/a |
| PDH_0127 | TG | 2 | n/a |
| PDH_0128 | QG | 2 | n/a |
| PDH_0129 | QP | 2 | n/a |
| PDH_0130 | QT | 2 | n/a |
| PDH_0131 | KT | 2 | n/a |
| PDH_0132 | KP | 2 | n/a |
| PDH_0133 | IP | 2 | n/a |
| PDH_0134 | TP | 2 | n/a |
| PDH_0135 | TT | 2 | n/a |
| PDH_0136 | IT | 2 | n/a |
| PDH_0137 | IH | 2 | n/a |
| PDH_0138 | IY | 2 | n/a |
| PDH_0139 | TH | 2 | n/a |
| PDH_0140 | TY | 2 | n/a |
| PDH_0141 | RR | 2 | n/a |
| PDH_0142 | QL | 2 | n/a |
| PDH_0143 | QQ | 2 | n/a |
| PDH_0144 | PL | 2 | n/a |
| PDH_0145 | RP | 2 | n/a |
| PDH_0146 | PR | 2 | n/a |
| PDH_0147 | RL | 2 | n/a |
| PDH_0148 | QR | 2 | n/a |
| PDH_0149 | PM | 2 | n/a |
| PDH_0150 | TM | 2 | n/a |
| PDH_0151 | RT | 2 | n/a |
| PDH_0152 | RM | 2 | n/a |
| PDH_0153 | SM | 2 | n/a |
| PDH_0154 | QA | 2 | n/a |
| PDH_0155 | RA | 2 | n/a |
| PDH_0156 | QS | 2 | n/a |
| PDH_0157 | QV | 2 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0158 | RS | 2 | n/a |
| PDH_0159 | QW | 2 | n/a |
| PDH_0160 | RW | 2 | n/a |
| PDH_0161 | RV | 2 | n/a |
| PDH_0162 | WS | 2 | n/a |
| PDH_0163 | WT | 2 | n/a |
| PDH_0164 | TS | 2 | n/a |
| PDH_0165 | WP | 2 | n/a |
| PDH_0166 | SS | 2 | n/a |
| PDH_0167 | WV | 2 | n/a |
| PDH_0168 | WF | 2 | n/a |
| PDH_0169 | RF | 2 | n/a |
| PDH_0170 | WA | 2 | n/a |
| PDH_0171 | WD | 2 | n/a |
| PDH_0172 | WY | 2 | n/a |
| PDH_0173 | WQ | 2 | n/a |
| PDH_0174 | WE | 2 | n/a |
| PDH_0175 | WH | 2 | n/a |
| PDH_0176 | YK | 2 | n/a |
| PDH_0177 | FK | 2 | n/a |
| PDH_0178 | DK | 2 | n/a |
| PDH_0179 | HK | 2 | n/a |
| PDH_0180 | LW | 2 | n/a |
| PDH_0181 | PW | 2 | n/a |
| PDH_0182 | HW | 2 | n/a |
| PDH_0183 | WI | 2 | n/a |
| PDH_0184 | WG | 2 | n/a |
| PDH_0185 | WL | 2 | n/a |
| PDH_0186 | WR | 2 | n/a |
| PDH_0187 | YS | 2 | n/a |
| PDH_0188 | LS | 2 | n/a |
| PDH_0189 | HS | 2 | n/a |
| PDH_0190 | FS | 2 | n/a |
| PDH_0191 | PS | 2 | n/a |
| PDH_0192 | VS | 2 | n/a |
| PDH_0193 | GI | 2 | n/a |
| PDH_0194 | HI | 2 | n/a |
| PDH_0195 | RI | 2 | n/a |
| PDH_0196 | DI | 2 | n/a |
| PDH_0197 | TF | 2 | n/a |
| PDH_0198 | TL | 2 | n/a |
| PDH_0199 | TV | 2 | n/a |
| PDH_0200 | TA | 2 | n/a |
| PDH_0201 | PA | 2 | n/a |
| PDH_0202 | HA | 2 | n/a |
| PDH_0203 | DA | 2 | n/a |
| PDH_0204 | AA | 2 | n/a |
| PDH_0205 | MR | 2 | n/a |
| PDH_0206 | MA | 2 | n/a |
| PDH_0207 | MD | 2 | n/a |
| PDH_0208 | MP | 2 | n/a |
| PDH_0209 | MH | 2 | n/a |
| PDH_0210 | MG | 2 | n/a |
| PDH_0211 | VR | 2 | n/a |
| PDH_0212 | ER | 2 | n/a |
| PDH_0213 | LR | 2 | n/a |
| PDH_0214 | VAL | 3 | n/a |
| PDH_0215 | VAR | 3 | n/a |
| PDH_0216 | VAI | 3 | n/a |
| PDH_0217 | VAA | 3 | n/a |
| PDH_0218 | VAT | 3 | n/a |
| PDH_0219 | VAP | 3 | n/a |
| PDH_0220 | VAV | 3 | n/a |
| PDH_0221 | VAG | 3 | n/a |
| PDH_0222 | VAS | 3 | n/a |
| PDH_0223 | VVL | 3 | n/a |
| PDH_0224 | VEL | 3 | n/a |
| PDH_0225 | REL | 3 | n/a |
| PDH_0226 | TLL | 3 | n/a |
| PDH_0227 | WEL | 3 | n/a |
| PDH_0228 | RLL | 3 | n/a |
| PDH_0229 | TQL | 3 | n/a |
| PDH_0230 | RVL | 3 | n/a |
| PDH_0231 | GLL | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0232 | TEL | 3 | n/a |
| PDH_0233 | GVL | 3 | n/a |
| PDH_0234 | LQL | 3 | n/a |
| PDH_0235 | MEL | 3 | n/a |
| PDH_0236 | SLL | 3 | n/a |
| PDH_0237 | LVL | 3 | n/a |
| PDH_0238 | MQL | 3 | n/a |
| PDH_0239 | AVL | 3 | n/a |
| PDH_0240 | AQL | 3 | n/a |
| PDH_0241 | SQL | 3 | n/a |
| PDH_0242 | GQL | 3 | n/a |
| PDH_0243 | LEL | 3 | n/a |
| PDH_0244 | TVL | 3 | n/a |
| PDH_0245 | RQL | 3 | n/a |
| PDH_0246 | LLL | 3 | n/a |
| PDH_0247 | VQL | 3 | n/a |
| PDH_0248 | ALL | 3 | n/a |
| PDH_0249 | AEL | 3 | n/a |
| PDH_0250 | WLL | 3 | n/a |
| PDH_0251 | WVL | 3 | n/a |
| PDH_0252 | SEL | 3 | n/a |
| PDH_0253 | VLL | 3 | n/a |
| PDH_0254 | MVL | 3 | n/a |
| PDH_0255 | GEL | 3 | n/a |
| PDH_0256 | MLL | 3 | n/a |
| PDH_0257 | SVL | 3 | n/a |
| PDH_0258 | WQL | 3 | n/a |
| PDH_0259 | ISG | 3 | n/a |
| PDH_0260 | DSG | 3 | n/a |
| PDH_0261 | VPG | 3 | n/a |
| PDH_0262 | VSG | 3 | n/a |
| PDH_0263 | GAG | 3 | n/a |
| PDH_0264 | IPG | 3 | n/a |
| PDH_0265 | APG | 3 | n/a |
| PDH_0266 | TSG | 3 | n/a |
| PDH_0267 | DPG | 3 | n/a |
| PDH_0268 | LSG | 3 | n/a |
| PDH_0269 | LAG | 3 | n/a |
| PDH_0270 | NPG | 3 | n/a |
| PDH_0271 | PAG | 3 | n/a |
| PDH_0272 | SAG | 3 | n/a |
| PDH_0273 | ASG | 3 | n/a |
| PDH_0274 | RPG | 3 | n/a |
| PDH_0275 | HPG | 3 | n/a |
| PDH_0276 | GSG | 3 | n/a |
| PDH_0277 | GPG | 3 | n/a |
| PDH_0278 | IAG | 3 | n/a |
| PDH_0279 | LPG | 3 | n/a |
| PDH_0280 | AAG | 3 | n/a |
| PDH_0281 | TPG | 3 | n/a |
| PDH_0282 | PSG | 3 | n/a |
| PDH_0283 | PPG | 3 | n/a |
| PDH_0284 | SPG | 3 | n/a |
| PDH_0285 | RAG | 3 | n/a |
| PDH_0286 | HAG | 3 | n/a |
| PDH_0287 | SSG | 3 | n/a |
| PDH_0288 | HSG | 3 | n/a |
| PDH_0289 | RSG | 3 | n/a |
| PDH_0290 | TAG | 3 | n/a |
| PDH_0291 | DAG | 3 | n/a |
| PDH_0292 | NAG | 3 | n/a |
| PDH_0293 | NSG | 3 | n/a |
| PDH_0294 | GTY | 3 | n/a |
| PDH_0295 | ITY | 3 | n/a |
| PDH_0296 | LTY | 3 | n/a |
| PDH_0297 | ISY | 3 | n/a |
| PDH_0298 | GAY | 3 | n/a |
| PDH_0299 | LAY | 3 | n/a |
| PDH_0300 | HSY | 3 | n/a |
| PDH_0301 | AAY | 3 | n/a |
| PDH_0302 | ASY | 3 | n/a |
| PDH_0303 | TAY | 3 | n/a |
| PDH_0304 | NAY | 3 | n/a |
| PDH_0305 | HTY | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0306 | RTY | 3 | n/a |
| PDH_0307 | PTY | 3 | n/a |
| PDH_0308 | RAY | 3 | n/a |
| PDH_0309 | ATY | 3 | n/a |
| PDH_0310 | STY | 3 | n/a |
| PDH_0311 | DSY | 3 | n/a |
| PDH_0312 | GSY | 3 | n/a |
| PDH_0313 | IAY | 3 | n/a |
| PDH_0314 | PAY | 3 | n/a |
| PDH_0315 | VTY | 3 | n/a |
| PDH_0316 | PSY | 3 | n/a |
| PDH_0317 | TTY | 3 | n/a |
| PDH_0318 | VAY | 3 | n/a |
| PDH_0319 | NTY | 3 | n/a |
| PDH_0320 | DAY | 3 | n/a |
| PDH_0321 | TSY | 3 | n/a |
| PDH_0322 | DTY | 3 | n/a |
| PDH_0323 | RSY | 3 | n/a |
| PDH_0324 | SSY | 3 | n/a |
| PDH_0325 | NSY | 3 | n/a |
| PDH_0326 | SAY | 3 | n/a |
| PDH_0327 | HAY | 3 | n/a |
| PDH_0328 | LSY | 3 | n/a |
| PDH_0329 | VSY | 3 | n/a |
| PDH_0330 | IVL | 3 | n/a |
| PDH_0331 | KWL | 3 | n/a |
| PDH_0332 | KVL | 3 | n/a |
| PDH_0333 | PLL | 3 | n/a |
| PDH_0334 | LGL | 3 | n/a |
| PDH_0335 | QWL | 3 | n/a |
| PDH_0336 | EGL | 3 | n/a |
| PDH_0337 | EWL | 3 | n/a |
| PDH_0338 | EVL | 3 | n/a |
| PDH_0339 | QLL | 3 | n/a |
| PDH_0340 | AGL | 3 | n/a |
| PDH_0341 | VWL | 3 | n/a |
| PDH_0342 | ELL | 3 | n/a |
| PDH_0343 | KGL | 3 | n/a |
| PDH_0344 | ILL | 3 | n/a |
| PDH_0345 | IGL | 3 | n/a |
| PDH_0346 | AWL | 3 | n/a |
| PDH_0347 | LWL | 3 | n/a |
| PDH_0348 | QGL | 3 | n/a |
| PDH_0349 | PVL | 3 | n/a |
| PDH_0350 | VGL | 3 | n/a |
| PDH_0351 | IWL | 3 | n/a |
| PDH_0352 | KLL | 3 | n/a |
| PDH_0353 | PGL | 3 | n/a |
| PDH_0354 | PWL | 3 | n/a |
| PDH_0355 | QVL | 3 | n/a |
| PDH_0356 | TGL | 3 | n/a |
| PDH_0357 | TWL | 3 | n/a |
| PDH_0358 | PAD | 3 | n/a |
| PDH_0359 | PAL | 3 | n/a |
| PDH_0360 | PAA | 3 | n/a |
| PDH_0361 | PAH | 3 | n/a |
| PDH_0362 | PAP | 3 | n/a |
| PDH_0363 | PAS | 3 | n/a |
| PDH_0364 | PAF | 3 | n/a |
| PDH_0365 | PAV | 3 | n/a |
| PDH_0366 | IQL | 3 | n/a |
| PDH_0367 | KRL | 3 | n/a |
| PDH_0368 | PRL | 3 | n/a |
| PDH_0369 | KQL | 3 | n/a |
| PDH_0370 | QRL | 3 | n/a |
| PDH_0371 | KEL | 3 | n/a |
| PDH_0372 | EEL | 3 | n/a |
| PDH_0373 | PEL | 3 | n/a |
| PDH_0374 | VRL | 3 | n/a |
| PDH_0375 | QEL | 3 | n/a |
| PDH_0376 | LRL | 3 | n/a |
| PDH_0377 | IEL | 3 | n/a |
| PDH_0378 | QQL | 3 | n/a |
| PDH_0379 | IRL | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0380 | EQL | 3 | n/a |
| PDH_0381 | ERL | 3 | n/a |
| PDH_0382 | TRL | 3 | n/a |
| PDH_0383 | ARL | 3 | n/a |
| PDH_0384 | PQL | 3 | n/a |
| PDH_0385 | HSS | 3 | n/a |
| PDH_0386 | VST | 3 | n/a |
| PDH_0387 | HSA | 3 | n/a |
| PDH_0388 | YSG | 3 | n/a |
| PDH_0389 | ASS | 3 | n/a |
| PDH_0390 | HST | 3 | n/a |
| PDH_0391 | VSS | 3 | n/a |
| PDH_0392 | YSA | 3 | n/a |
| PDH_0393 | DST | 3 | n/a |
| PDH_0394 | PST | 3 | n/a |
| PDH_0395 | AST | 3 | n/a |
| PDH_0396 | FSS | 3 | n/a |
| PDH_0397 | LST | 3 | n/a |
| PDH_0398 | SST | 3 | n/a |
| PDH_0399 | FST | 3 | n/a |
| PDH_0400 | FSG | 3 | n/a |
| PDH_0401 | SSS | 3 | n/a |
| PDH_0402 | LSA | 3 | n/a |
| PDH_0403 | LSS | 3 | n/a |
| PDH_0404 | PSA | 3 | n/a |
| PDH_0405 | DSA | 3 | n/a |
| PDH_0406 | ASA | 3 | n/a |
| PDH_0407 | SSA | 3 | n/a |
| PDH_0408 | DSS | 3 | n/a |
| PDH_0409 | PSS | 3 | n/a |
| PDH_0410 | YSS | 3 | n/a |
| PDH_0411 | FSA | 3 | n/a |
| PDH_0412 | YST | 3 | n/a |
| PDH_0413 | VSA | 3 | n/a |
| PDH_0414 | SGA | 3 | n/a |
| PDH_0415 | AGD | 3 | n/a |
| PDH_0416 | LGA | 3 | n/a |
| PDH_0417 | SGY | 3 | n/a |
| PDH_0418 | SGD | 3 | n/a |
| PDH_0419 | FGY | 3 | n/a |
| PDH_0420 | DGY | 3 | n/a |
| PDH_0421 | LGS | 3 | n/a |
| PDH_0422 | FGS | 3 | n/a |
| PDH_0423 | DGS | 3 | n/a |
| PDH_0424 | YGS | 3 | n/a |
| PDH_0425 | YGA | 3 | n/a |
| PDH_0426 | VGD | 3 | n/a |
| PDH_0427 | PGS | 3 | n/a |
| PDH_0428 | VGY | 3 | n/a |
| PDH_0429 | VGS | 3 | n/a |
| PDH_0430 | VGA | 3 | n/a |
| PDH_0431 | LGD | 3 | n/a |
| PDH_0432 | AGY | 3 | n/a |
| PDH_0433 | LGY | 3 | n/a |
| PDH_0434 | HGD | 3 | n/a |
| PDH_0435 | HGA | 3 | n/a |
| PDH_0436 | PGA | 3 | n/a |
| PDH_0437 | YGD | 3 | n/a |
| PDH_0438 | PGD | 3 | n/a |
| PDH_0439 | YGY | 3 | n/a |
| PDH_0440 | PGY | 3 | n/a |
| PDH_0441 | SGS | 3 | n/a |
| PDH_0442 | HGY | 3 | n/a |
| PDH_0443 | FGD | 3 | n/a |
| PDH_0444 | FGA | 3 | n/a |
| PDH_0445 | AGS | 3 | n/a |
| PDH_0446 | DGD | 3 | n/a |
| PDH_0447 | DGA | 3 | n/a |
| PDH_0448 | HGS | 3 | n/a |
| PDH_0449 | AGA | 3 | n/a |
| PDH_0450 | SGV | 3 | n/a |
| PDH_0451 | LGV | 3 | n/a |
| PDH_0452 | AGG | 3 | n/a |
| PDH_0453 | SGG | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0454 | DGV | 3 | n/a |
| PDH_0455 | PGV | 3 | n/a |
| PDH_0456 | HGV | 3 | n/a |
| PDH_0457 | YGV | 3 | n/a |
| PDH_0458 | LGG | 3 | n/a |
| PDH_0459 | VGG | 3 | n/a |
| PDH_0460 | VGV | 3 | n/a |
| PDH_0461 | FGV | 3 | n/a |
| PDH_0462 | PGG | 3 | n/a |
| PDH_0463 | YGG | 3 | n/a |
| PDH_0464 | HGG | 3 | n/a |
| PDH_0465 | DGG | 3 | n/a |
| PDH_0466 | AGV | 3 | n/a |
| PDH_0467 | FGG | 3 | n/a |
| PDH_0468 | HSD | 3 | n/a |
| PDH_0469 | YSD | 3 | n/a |
| PDH_0470 | ASD | 3 | n/a |
| PDH_0471 | FSY | 3 | n/a |
| PDH_0472 | FSD | 3 | n/a |
| PDH_0473 | SSD | 3 | n/a |
| PDH_0474 | VSD | 3 | n/a |
| PDH_0475 | PSD | 3 | n/a |
| PDH_0476 | LSD | 3 | n/a |
| PDH_0477 | YSY | 3 | n/a |
| PDH_0478 | DSD | 3 | n/a |
| PDH_0479 | SRL | 3 | n/a |
| PDH_0480 | DQL | 3 | n/a |
| PDH_0481 | FRL | 3 | n/a |
| PDH_0482 | YRL | 3 | n/a |
| PDH_0483 | HQL | 3 | n/a |
| PDH_0484 | NQL | 3 | n/a |
| PDH_0485 | NRL | 3 | n/a |
| PDH_0486 | FQL | 3 | n/a |
| PDH_0487 | DRL | 3 | n/a |
| PDH_0488 | HRL | 3 | n/a |
| PDH_0489 | YQL | 3 | n/a |
| PDH_0490 | VSW | 3 | n/a |
| PDH_0491 | PSW | 3 | n/a |
| PDH_0492 | HSW | 3 | n/a |
| PDH_0493 | NSW | 3 | n/a |
| PDH_0494 | FSW | 3 | n/a |
| PDH_0495 | ASW | 3 | n/a |
| PDH_0496 | TSW | 3 | n/a |
| PDH_0497 | LSW | 3 | n/a |
| PDH_0498 | DSW | 3 | n/a |
| PDH_0499 | ISW | 3 | n/a |
| PDH_0500 | SSW | 3 | n/a |
| PDH_0501 | YSW | 3 | n/a |
| PDH_0502 | SGW | 3 | n/a |
| PDH_0503 | FGW | 3 | n/a |
| PDH_0504 | LGW | 3 | n/a |
| PDH_0505 | AGW | 3 | n/a |
| PDH_0506 | VGW | 3 | n/a |
| PDH_0507 | YGW | 3 | n/a |
| PDH_0508 | PGW | 3 | n/a |
| PDH_0509 | DGW | 3 | n/a |
| PDH_0510 | HGW | 3 | n/a |
| PDH_0511 | IGD | 3 | n/a |
| PDH_0512 | GGA | 3 | n/a |
| PDH_0513 | IGG | 3 | n/a |
| PDH_0514 | GGD | 3 | n/a |
| PDH_0515 | GGV | 3 | n/a |
| PDH_0516 | RGD | 3 | n/a |
| PDH_0517 | TGV | 3 | n/a |
| PDH_0518 | RGV | 3 | n/a |
| PDH_0519 | GGG | 3 | n/a |
| PDH_0520 | IGA | 3 | n/a |
| PDH_0521 | IGV | 3 | n/a |
| PDH_0522 | RGG | 3 | n/a |
| PDH_0523 | RGA | 3 | n/a |
| PDH_0524 | TGD | 3 | n/a |
| PDH_0525 | TGA | 3 | n/a |
| PDH_0526 | TGG | 3 | n/a |
| PDH_0527 | NSA | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0528 | NSD | 3 | n/a |
| PDH_0529 | TSD | 3 | n/a |
| PDH_0530 | TSA | 3 | n/a |
| PDH_0531 | ISA | 3 | n/a |
| PDH_0532 | ISD | 3 | n/a |
| PDH_0533 | HYD | 3 | n/a |
| PDH_0534 | HYG | 3 | n/a |
| PDH_0535 | FYD | 3 | n/a |
| PDH_0536 | FYG | 3 | n/a |
| PDH_0537 | LYA | 3 | n/a |
| PDH_0538 | LYD | 3 | n/a |
| PDH_0539 | VYA | 3 | n/a |
| PDH_0540 | VYD | 3 | n/a |
| PDH_0541 | TYA | 3 | n/a |
| PDH_0542 | LYG | 3 | n/a |
| PDH_0543 | DYD | 3 | n/a |
| PDH_0544 | HYA | 3 | n/a |
| PDH_0545 | TYD | 3 | n/a |
| PDH_0546 | TYG | 3 | n/a |
| PDH_0547 | YYA | 3 | n/a |
| PDH_0548 | DYG | 3 | n/a |
| PDH_0549 | YYD | 3 | n/a |
| PDH_0550 | NYG | 3 | n/a |
| PDH_0551 | NYD | 3 | n/a |
| PDH_0552 | PYG | 3 | n/a |
| PDH_0553 | YYG | 3 | n/a |
| PDH_0554 | PYD | 3 | n/a |
| PDH_0555 | NYA | 3 | n/a |
| PDH_0556 | FYA | 3 | n/a |
| PDH_0557 | PYA | 3 | n/a |
| PDH_0558 | VYG | 3 | n/a |
| PDH_0559 | AYD | 3 | n/a |
| PDH_0560 | IYG | 3 | n/a |
| PDH_0561 | AYA | 3 | n/a |
| PDH_0562 | SYG | 3 | n/a |
| PDH_0563 | IYD | 3 | n/a |
| PDH_0564 | IYA | 3 | n/a |
| PDH_0565 | AYG | 3 | n/a |
| PDH_0566 | DYA | 3 | n/a |
| PDH_0567 | SYD | 3 | n/a |
| PDH_0568 | SYA | 3 | n/a |
| PDH_0569 | TSE | 3 | n/a |
| PDH_0570 | HSE | 3 | n/a |
| PDH_0571 | YSE | 3 | n/a |
| PDH_0572 | ASE | 3 | n/a |
| PDH_0573 | NSE | 3 | n/a |
| PDH_0574 | FSE | 3 | n/a |
| PDH_0575 | DSE | 3 | n/a |
| PDH_0576 | ISE | 3 | n/a |
| PDH_0577 | SSE | 3 | n/a |
| PDH_0578 | VSE | 3 | n/a |
| PDH_0579 | PSE | 3 | n/a |
| PDH_0580 | LSE | 3 | n/a |
| PDH_0581 | EWP | 3 | n/a |
| PDH_0582 | PWP | 3 | n/a |
| PDH_0583 | KWA | 3 | n/a |
| PDH_0584 | IWP | 3 | n/a |
| PDH_0585 | LWA | 3 | n/a |
| PDH_0586 | LWV | 3 | n/a |
| PDH_0587 | AWV | 3 | n/a |
| PDH_0588 | AWA | 3 | n/a |
| PDH_0589 | PWA | 3 | n/a |
| PDH_0590 | QWP | 3 | n/a |
| PDH_0591 | PWV | 3 | n/a |
| PDH_0592 | TWV | 3 | n/a |
| PDH_0593 | TWP | 3 | n/a |
| PDH_0594 | QWA | 3 | n/a |
| PDH_0595 | KWP | 3 | n/a |
| PDH_0596 | QWV | 3 | n/a |
| PDH_0597 | EWV | 3 | n/a |
| PDH_0598 | VWA | 3 | n/a |
| PDH_0599 | AWP | 3 | n/a |
| PDH_0600 | VWV | 3 | n/a |
| PDH_0601 | TWA | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0602 | EWA | 3 | n/a |
| PDH_0603 | IWV | 3 | n/a |
| PDH_0604 | VWP | 3 | n/a |
| PDH_0605 | IWA | 3 | n/a |
| PDH_0606 | LWP | 3 | n/a |
| PDH_0607 | KWV | 3 | n/a |
| PDH_0608 | HDY | 3 | n/a |
| PDH_0609 | IVY | 3 | n/a |
| PDH_0610 | PVY | 3 | n/a |
| PDH_0611 | AVY | 3 | n/a |
| PDH_0612 | GVY | 3 | n/a |
| PDH_0613 | LVY | 3 | n/a |
| PDH_0614 | GDY | 3 | n/a |
| PDH_0615 | ADY | 3 | n/a |
| PDH_0616 | VVY | 3 | n/a |
| PDH_0617 | NVY | 3 | n/a |
| PDH_0618 | SDY | 3 | n/a |
| PDH_0619 | RVY | 3 | n/a |
| PDH_0620 | LDY | 3 | n/a |
| PDH_0621 | HVY | 3 | n/a |
| PDH_0622 | PDY | 3 | n/a |
| PDH_0623 | RDY | 3 | n/a |
| PDH_0624 | SVY | 3 | n/a |
| PDH_0625 | IDY | 3 | n/a |
| PDH_0626 | DDY | 3 | n/a |
| PDH_0627 | NDY | 3 | n/a |
| PDH_0628 | VDY | 3 | n/a |
| PDH_0629 | DVY | 3 | n/a |
| PDH_0630 | TVY | 3 | n/a |
| PDH_0631 | TDY | 3 | n/a |
| PDH_0632 | GKL | 3 | n/a |
| PDH_0633 | GIL | 3 | n/a |
| PDH_0634 | GRL | 3 | n/a |
| PDH_0635 | GGL | 3 | n/a |
| PDH_0636 | GAL | 3 | n/a |
| PDH_0637 | GTL | 3 | n/a |
| PDH_0638 | LRG | 3 | n/a |
| PDH_0639 | DTG | 3 | n/a |
| PDH_0640 | ARG | 3 | n/a |
| PDH_0641 | YIG | 3 | n/a |
| PDH_0642 | ITG | 3 | n/a |
| PDH_0643 | PIG | 3 | n/a |
| PDH_0644 | DIG | 3 | n/a |
| PDH_0645 | ATG | 3 | n/a |
| PDH_0646 | STG | 3 | n/a |
| PDH_0647 | HTG | 3 | n/a |
| PDH_0648 | VRG | 3 | n/a |
| PDH_0649 | YRG | 3 | n/a |
| PDH_0650 | NIG | 3 | n/a |
| PDH_0651 | VIG | 3 | n/a |
| PDH_0652 | IRG | 3 | n/a |
| PDH_0653 | LTG | 3 | n/a |
| PDH_0654 | SRG | 3 | n/a |
| PDH_0655 | VTG | 3 | n/a |
| PDH_0656 | AIG | 3 | n/a |
| PDH_0657 | IIG | 3 | n/a |
| PDH_0658 | FTG | 3 | n/a |
| PDH_0659 | HIG | 3 | n/a |
| PDH_0660 | HRG | 3 | n/a |
| PDH_0661 | PTG | 3 | n/a |
| PDH_0662 | YTG | 3 | n/a |
| PDH_0663 | PRG | 3 | n/a |
| PDH_0664 | TIG | 3 | n/a |
| PDH_0665 | DRG | 3 | n/a |
| PDH_0666 | TRG | 3 | n/a |
| PDH_0667 | FIG | 3 | n/a |
| PDH_0668 | NTG | 3 | n/a |
| PDH_0669 | FRG | 3 | n/a |
| PDH_0670 | LIG | 3 | n/a |
| PDH_0671 | NRG | 3 | n/a |
| PDH_0672 | TTG | 3 | n/a |
| PDH_0673 | SIG | 3 | n/a |
| PDH_0674 | EAG | 3 | n/a |
| PDH_0675 | KAV | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0676 | IAD | 3 | n/a |
| PDH_0677 | IAV | 3 | n/a |
| PDH_0678 | KAD | 3 | n/a |
| PDH_0679 | QAA | 3 | n/a |
| PDH_0680 | LAA | 3 | n/a |
| PDH_0681 | QAD | 3 | n/a |
| PDH_0682 | AAD | 3 | n/a |
| PDH_0683 | AAA | 3 | n/a |
| PDH_0684 | LAD | 3 | n/a |
| PDH_0685 | VAD | 3 | n/a |
| PDH_0686 | TAA | 3 | n/a |
| PDH_0687 | TAD | 3 | n/a |
| PDH_0688 | TAV | 3 | n/a |
| PDH_0689 | EAA | 3 | n/a |
| PDH_0690 | AAV | 3 | n/a |
| PDH_0691 | QAV | 3 | n/a |
| PDH_0692 | EAV | 3 | n/a |
| PDH_0693 | LAV | 3 | n/a |
| PDH_0694 | QAG | 3 | n/a |
| PDH_0695 | KAA | 3 | n/a |
| PDH_0696 | IAA | 3 | n/a |
| PDH_0697 | KAG | 3 | n/a |
| PDH_0698 | EAD | 3 | n/a |
| PDH_0699 | WVG | 3 | n/a |
| PDH_0700 | VFG | 3 | n/a |
| PDH_0701 | SFG | 3 | n/a |
| PDH_0702 | RFG | 3 | n/a |
| PDH_0703 | WAG | 3 | n/a |
| PDH_0704 | WFG | 3 | n/a |
| PDH_0705 | SVG | 3 | n/a |
| PDH_0706 | TVG | 3 | n/a |
| PDH_0707 | GFG | 3 | n/a |
| PDH_0708 | MVG | 3 | n/a |
| PDH_0709 | MFG | 3 | n/a |
| PDH_0710 | LVG | 3 | n/a |
| PDH_0711 | WSG | 3 | n/a |
| PDH_0712 | AFG | 3 | n/a |
| PDH_0713 | MAG | 3 | n/a |
| PDH_0714 | LFG | 3 | n/a |
| PDH_0715 | MSG | 3 | n/a |
| PDH_0716 | VVG | 3 | n/a |
| PDH_0717 | RVG | 3 | n/a |
| PDH_0718 | AVG | 3 | n/a |
| PDH_0719 | GVG | 3 | n/a |
| PDH_0720 | TFG | 3 | n/a |
| PDH_0721 | DGI | 3 | n/a |
| PDH_0722 | LGI | 3 | n/a |
| PDH_0723 | SGI | 3 | n/a |
| PDH_0724 | HGI | 3 | n/a |
| PDH_0725 | PGI | 3 | n/a |
| PDH_0726 | VGI | 3 | n/a |
| PDH_0727 | YGI | 3 | n/a |
| PDH_0728 | FGI | 3 | n/a |
| PDH_0729 | AGI | 3 | n/a |
| PDH_0730 | DVD | 3 | n/a |
| PDH_0731 | FVA | 3 | n/a |
| PDH_0732 | DVA | 3 | n/a |
| PDH_0733 | YVD | 3 | n/a |
| PDH_0734 | YVA | 3 | n/a |
| PDH_0735 | DVG | 3 | n/a |
| PDH_0736 | HVG | 3 | n/a |
| PDH_0737 | VVD | 3 | n/a |
| PDH_0738 | HVD | 3 | n/a |
| PDH_0739 | VVA | 3 | n/a |
| PDH_0740 | IVA | 3 | n/a |
| PDH_0741 | AVD | 3 | n/a |
| PDH_0742 | YVG | 3 | n/a |
| PDH_0743 | TVD | 3 | n/a |
| PDH_0744 | FVG | 3 | n/a |
| PDH_0745 | FVD | 3 | n/a |
| PDH_0746 | TVA | 3 | n/a |
| PDH_0747 | PVG | 3 | n/a |
| PDH_0748 | PVA | 3 | n/a |
| PDH_0749 | AVA | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0750 | PVD | 3 | n/a |
| PDH_0751 | NVG | 3 | n/a |
| PDH_0752 | IVD | 3 | n/a |
| PDH_0753 | HVA | 3 | n/a |
| PDH_0754 | SVA | 3 | n/a |
| PDH_0755 | SVD | 3 | n/a |
| PDH_0756 | IVG | 3 | n/a |
| PDH_0757 | NVA | 3 | n/a |
| PDH_0758 | LVD | 3 | n/a |
| PDH_0759 | LVA | 3 | n/a |
| PDH_0760 | NVD | 3 | n/a |
| PDH_0761 | AYY | 3 | n/a |
| PDH_0762 | LFY | 3 | n/a |
| PDH_0763 | RFY | 3 | n/a |
| PDH_0764 | IFY | 3 | n/a |
| PDH_0765 | TYY | 3 | n/a |
| PDH_0766 | RYY | 3 | n/a |
| PDH_0767 | PYY | 3 | n/a |
| PDH_0768 | VYY | 3 | n/a |
| PDH_0769 | SFY | 3 | n/a |
| PDH_0770 | GYY | 3 | n/a |
| PDH_0771 | GFY | 3 | n/a |
| PDH_0772 | DFY | 3 | n/a |
| PDH_0773 | VFY | 3 | n/a |
| PDH_0774 | HYY | 3 | n/a |
| PDH_0775 | SYY | 3 | n/a |
| PDH_0776 | PFY | 3 | n/a |
| PDH_0777 | LYY | 3 | n/a |
| PDH_0778 | IYY | 3 | n/a |
| PDH_0779 | TFY | 3 | n/a |
| PDH_0780 | NFY | 3 | n/a |
| PDH_0781 | HFY | 3 | n/a |
| PDH_0782 | AFY | 3 | n/a |
| PDH_0783 | DYY | 3 | n/a |
| PDH_0784 | NYY | 3 | n/a |
| PDH_0785 | VVV | 3 | n/a |
| PDH_0786 | VVF | 3 | n/a |
| PDH_0787 | VVP | 3 | n/a |
| PDH_0788 | VVH | 3 | n/a |
| PDH_0789 | VVS | 3 | n/a |
| PDH_0790 | GDL | 3 | n/a |
| PDH_0791 | SAL | 3 | n/a |
| PDH_0792 | RAL | 3 | n/a |
| PDH_0793 | RGL | 3 | n/a |
| PDH_0794 | IAL | 3 | n/a |
| PDH_0795 | LDL | 3 | n/a |
| PDH_0796 | TDL | 3 | n/a |
| PDH_0797 | ADL | 3 | n/a |
| PDH_0798 | VDL | 3 | n/a |
| PDH_0799 | IDL | 3 | n/a |
| PDH_0800 | SDL | 3 | n/a |
| PDH_0801 | TAL | 3 | n/a |
| PDH_0802 | RDL | 3 | n/a |
| PDH_0803 | AAL | 3 | n/a |
| PDH_0804 | SGL | 3 | n/a |
| PDH_0805 | PDL | 3 | n/a |
| PDH_0806 | LAL | 3 | n/a |
| PDH_0807 | AGE | 3 | n/a |
| PDH_0808 | SGE | 3 | n/a |
| PDH_0809 | HGE | 3 | n/a |
| PDH_0810 | LGE | 3 | n/a |
| PDH_0811 | VGE | 3 | n/a |
| PDH_0812 | PGE | 3 | n/a |
| PDH_0813 | YGE | 3 | n/a |
| PDH_0814 | DGE | 3 | n/a |
| PDH_0815 | FGE | 3 | n/a |
| PDH_0816 | SDG | 3 | n/a |
| PDH_0817 | NDG | 3 | n/a |
| PDH_0818 | GDG | 3 | n/a |
| PDH_0819 | HDG | 3 | n/a |
| PDH_0820 | ADG | 3 | n/a |
| PDH_0821 | TDG | 3 | n/a |
| PDH_0822 | IDG | 3 | n/a |
| PDH_0823 | DDG | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0824 | VDG | 3 | n/a |
| PDH_0825 | RDG | 3 | n/a |
| PDH_0826 | LDG | 3 | n/a |
| PDH_0827 | PDG | 3 | n/a |
| PDH_0828 | RHG | 3 | n/a |
| PDH_0829 | RLG | 3 | n/a |
| PDH_0830 | RYG | 3 | n/a |
| PDH_0831 | DLY | 3 | n/a |
| PDH_0832 | IWY | 3 | n/a |
| PDH_0833 | LWY | 3 | n/a |
| PDH_0834 | ALY | 3 | n/a |
| PDH_0835 | RWY | 3 | n/a |
| PDH_0836 | SLY | 3 | n/a |
| PDH_0837 | HLY | 3 | n/a |
| PDH_0838 | ILY | 3 | n/a |
| PDH_0839 | SWY | 3 | n/a |
| PDH_0840 | GLY | 3 | n/a |
| PDH_0841 | RLY | 3 | n/a |
| PDH_0842 | DWY | 3 | n/a |
| PDH_0843 | NLY | 3 | n/a |
| PDH_0844 | VWY | 3 | n/a |
| PDH_0845 | GWY | 3 | n/a |
| PDH_0846 | AWY | 3 | n/a |
| PDH_0847 | HWY | 3 | n/a |
| PDH_0848 | PLY | 3 | n/a |
| PDH_0849 | LLY | 3 | n/a |
| PDH_0850 | TWY | 3 | n/a |
| PDH_0851 | TLY | 3 | n/a |
| PDH_0852 | NWY | 3 | n/a |
| PDH_0853 | VLY | 3 | n/a |
| PDH_0854 | PWY | 3 | n/a |
| PDH_0855 | GSL | 3 | n/a |
| PDH_0856 | ISL | 3 | n/a |
| PDH_0857 | DWL | 3 | n/a |
| PDH_0858 | SSL | 3 | n/a |
| PDH_0859 | TSL | 3 | n/a |
| PDH_0860 | VSL | 3 | n/a |
| PDH_0861 | DSL | 3 | n/a |
| PDH_0862 | HWL | 3 | n/a |
| PDH_0863 | ASL | 3 | n/a |
| PDH_0864 | SWL | 3 | n/a |
| PDH_0865 | NWL | 3 | n/a |
| PDH_0866 | NLL | 3 | n/a |
| PDH_0867 | DLL | 3 | n/a |
| PDH_0868 | RSL | 3 | n/a |
| PDH_0869 | PSL | 3 | n/a |
| PDH_0870 | HLL | 3 | n/a |
| PDH_0871 | GWL | 3 | n/a |
| PDH_0872 | HSL | 3 | n/a |
| PDH_0873 | NSL | 3 | n/a |
| PDH_0874 | LSL | 3 | n/a |
| PDH_0875 | RWL | 3 | n/a |
| PDH_0876 | FDY | 3 | n/a |
| PDH_0877 | YYY | 3 | n/a |
| PDH_0878 | FYY | 3 | n/a |
| PDH_0879 | YDY | 3 | n/a |
| PDH_0880 | LIL | 3 | n/a |
| PDH_0881 | LKL | 3 | n/a |
| PDH_0882 | LTL | 3 | n/a |
| PDH_0883 | YAG | 3 | n/a |
| PDH_0884 | FPG | 3 | n/a |
| PDH_0885 | YPG | 3 | n/a |
| PDH_0886 | FAG | 3 | n/a |
| PDH_0887 | FYH | 3 | n/a |
| PDH_0888 | LYH | 3 | n/a |
| PDH_0889 | IYH | 3 | n/a |
| PDH_0890 | SYH | 3 | n/a |
| PDH_0891 | TYH | 3 | n/a |
| PDH_0892 | YYH | 3 | n/a |
| PDH_0893 | NYH | 3 | n/a |
| PDH_0894 | PYH | 3 | n/a |
| PDH_0895 | AYH | 3 | n/a |
| PDH_0896 | VYH | 3 | n/a |
| PDH_0897 | HYH | 3 | n/a |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0898 | DYH | 3 | n/a |
| PDH_0899 | YTAM | 4 | 5639 |
| PDH_0900 | HTAI | 4 | 5640 |
| PDH_0901 | YTAS | 4 | 5641 |
| PDH_0902 | YTAI | 4 | 5642 |
| PDH_0903 | YTAR | 4 | 5643 |
| PDH_0904 | PTAS | 4 | 5644 |
| PDH_0905 | LTAM | 4 | 5645 |
| PDH_0906 | DTAI | 4 | 5646 |
| PDH_0907 | FTAS | 4 | 5647 |
| PDH_0908 | FTAM | 4 | 5648 |
| PDH_0909 | LTAS | 4 | 5649 |
| PDH_0910 | ATAI | 4 | 5650 |
| PDH_0911 | STAI | 4 | 5651 |
| PDH_0912 | FTAR | 4 | 5652 |
| PDH_0913 | DTAM | 4 | 4420 |
| PDH_0914 | STAR | 4 | 5653 |
| PDH_0915 | LTAR | 4 | 5654 |
| PDH_0916 | FTAI | 4 | 5655 |
| PDH_0917 | LTAI | 4 | 5656 |
| PDH_0918 | STAM | 4 | 5657 |
| PDH_0919 | ATAM | 4 | 5658 |
| PDH_0920 | STAS | 4 | 5659 |
| PDH_0921 | ATAR | 4 | 5660 |
| PDH_0922 | HTAS | 4 | 5661 |
| PDH_0923 | HTAM | 4 | 5662 |
| PDH_0924 | VTAI | 4 | 3907 |
| PDH_0925 | DTAR | 4 | 5663 |
| PDH_0926 | HTAR | 4 | 5664 |
| PDH_0927 | ATAS | 4 | 5665 |
| PDH_0928 | VTAM | 4 | 5666 |
| PDH_0929 | PTAR | 4 | 5667 |
| PDH_0930 | DTAS | 4 | 5668 |
| PDH_0931 | VTAS | 4 | 5669 |
| PDH_0932 | PTAM | 4 | 5670 |
| PDH_0933 | VTAR | 4 | 5671 |
| PDH_0934 | PTAI | 4 | 5672 |
| PDH_0935 | LVAT | 4 | 5673 |
| PDH_0936 | LAAT | 4 | 5674 |
| PDH_0937 | MVAT | 4 | 5675 |
| PDH_0938 | TGAT | 4 | 5676 |
| PDH_0939 | AVAT | 4 | 5677 |
| PDH_0940 | VAAT | 4 | 3803 |
| PDH_0941 | PAAT | 4 | 5678 |
| PDH_0942 | KGAT | 4 | 5679 |
| PDH_0943 | EGAT | 4 | 5680 |
| PDH_0944 | PVAT | 4 | 5681 |
| PDH_0945 | AGAT | 4 | 5682 |
| PDH_0946 | QAAT | 4 | 5683 |
| PDH_0947 | AAAT | 4 | 5684 |
| PDH_0948 | VVAT | 4 | 5685 |
| PDH_0949 | VGAT | 4 | 3756 |
| PDH_0950 | TVAT | 4 | 5686 |
| PDH_0951 | EVAT | 4 | 5687 |
| PDH_0952 | LGAT | 4 | 5688 |
| PDH_0953 | KAAT | 4 | 5689 |
| PDH_0954 | MGAT | 4 | 5690 |
| PDH_0955 | PGAT | 4 | 5691 |
| PDH_0956 | QVAT | 4 | 5692 |
| PDH_0957 | KVAT | 4 | 5693 |
| PDH_0958 | EAAT | 4 | 5694 |
| PDH_0959 | TAAT | 4 | 5695 |
| PDH_0960 | MAAT | 4 | 5696 |
| PDH_0961 | QGAT | 4 | 5697 |
| PDH_0962 | RFGA | 4 | 5698 |
| PDH_0963 | MFGE | 4 | 5699 |
| PDH_0964 | MFGA | 4 | 5700 |
| PDH_0965 | VFGG | 4 | 5701 |
| PDH_0966 | RFGE | 4 | 5702 |
| PDH_0967 | MFGV | 4 | 5703 |
| PDH_0968 | VFGA | 4 | 5704 |
| PDH_0969 | VFGE | 4 | 5705 |
| PDH_0970 | VFGV | 4 | 5706 |
| PDH_0971 | MFGG | 4 | 5707 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_0972 | LFGV | 4 | 5708 |
| PDH_0973 | SFGE | 4 | 5709 |
| PDH_0974 | SFGA | 4 | 5710 |
| PDH_0975 | RFGG | 4 | 5711 |
| PDH_0976 | SFGV | 4 | 5712 |
| PDH_0977 | LFGA | 4 | 5713 |
| PDH_0978 | SFGG | 4 | 5714 |
| PDH_0979 | LFGG | 4 | 5715 |
| PDH_0980 | LFGE | 4 | 5716 |
| PDH_0981 | WFGE | 4 | 3966 |
| PDH_0982 | WFGG | 4 | 5717 |
| PDH_0983 | WFGV | 4 | 5718 |
| PDH_0984 | WFGA | 4 | 5719 |
| PDH_0985 | TFGG | 4 | 4154 |
| PDH_0986 | TFGE | 4 | 5720 |
| PDH_0987 | AFGV | 4 | 5721 |
| PDH_0988 | AFGA | 4 | 5722 |
| PDH_0989 | GFGV | 4 | 5723 |
| PDH_0990 | GFGA | 4 | 5724 |
| PDH_0991 | GFGG | 4 | 5725 |
| PDH_0992 | TFGV | 4 | 5726 |
| PDH_0993 | AFGE | 4 | 5727 |
| PDH_0994 | TFGA | 4 | 5728 |
| PDH_0995 | RFGV | 4 | 5729 |
| PDH_0996 | AFGG | 4 | 5730 |
| PDH_0997 | GFGE | 4 | 5731 |
| PDH_0998 | AGDY | 4 | 5732 |
| PDH_0999 | PGYY | 4 | 5733 |
| PDH_1000 | VGAY | 4 | 5734 |
| PDH_1001 | HGSY | 4 | 5735 |
| PDH_1002 | SGSY | 4 | 3763 |
| PDH_1003 | PGDY | 4 | 5736 |
| PDH_1004 | LGDY | 4 | 5737 |
| PDH_1005 | DGAY | 4 | 5738 |
| PDH_1006 | FGDY | 4 | 5739 |
| PDH_1007 | LGAY | 4 | 5740 |
| PDH_1008 | DGYY | 4 | 5741 |
| PDH_1009 | VGSY | 4 | 5742 |
| PDH_1010 | YGAY | 4 | 5743 |
| PDH_1011 | FGYY | 4 | 5744 |
| PDH_1012 | DGDY | 4 | 5745 |
| PDH_1013 | AGYY | 4 | 5746 |
| PDH_1014 | YGSY | 4 | 5747 |
| PDH_1015 | VGYY | 4 | 5748 |
| PDH_1016 | AGAY | 4 | 5749 |
| PDH_1017 | DGSY | 4 | 5750 |
| PDH_1018 | HGDY | 4 | 5751 |
| PDH_1019 | FGAY | 4 | 5752 |
| PDH_1020 | HGYY | 4 | 5753 |
| PDH_1021 | YGYY | 4 | 5754 |
| PDH_1022 | SGYY | 4 | 4187 |
| PDH_1023 | SGAY | 4 | 5755 |
| PDH_1024 | AGSY | 4 | 5756 |
| PDH_1025 | HGAY | 4 | 5757 |
| PDH_1026 | PGAY | 4 | 5758 |
| PDH_1027 | PGSY | 4 | 5759 |
| PDH_1028 | LGSY | 4 | 5760 |
| PDH_1029 | VGDY | 4 | 5761 |
| PDH_1030 | SGDY | 4 | 5762 |
| PDH_1031 | LGYY | 4 | 5763 |
| PDH_1032 | FGSY | 4 | 5764 |
| PDH_1033 | YGDY | 4 | 4350 |
| PDH_1034 | YSSV | 4 | 5765 |
| PDH_1035 | YSSI | 4 | 5766 |
| PDH_1036 | YSSS | 4 | 4442 |
| PDH_1037 | YSSR | 4 | 5767 |
| PDH_1038 | YSSP | 4 | 5768 |
| PDH_1039 | YSSA | 4 | 5769 |
| PDH_1040 | YSSL | 4 | 5770 |
| PDH_1041 | YSSG | 4 | 4462 |
| PDH_1042 | YSST | 4 | 5771 |
| PDH_1043 | EVRG | 4 | 5772 |
| PDH_1044 | PVRG | 4 | 5773 |
| PDH_1045 | PVTG | 4 | 5774 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1046 | EVAG | 4 | 5775 |
| PDH_1047 | MVTG | 4 | 5776 |
| PDH_1048 | MVGG | 4 | 5777 |
| PDH_1049 | EVGG | 4 | 3728 |
| PDH_1050 | QVRG | 4 | 5778 |
| PDH_1051 | MVRG | 4 | 4017 |
| PDH_1052 | QVGG | 4 | 5779 |
| PDH_1053 | VVAG | 4 | 5780 |
| PDH_1054 | EVTG | 4 | 5781 |
| PDH_1055 | VVRG | 4 | 5782 |
| PDH_1056 | PVAG | 4 | 5783 |
| PDH_1057 | LVAG | 4 | 5784 |
| PDH_1058 | LVRG | 4 | 5785 |
| PDH_1059 | QVTG | 4 | 5786 |
| PDH_1060 | PVGG | 4 | 5787 |
| PDH_1061 | AVGG | 4 | 5788 |
| PDH_1062 | TVGG | 4 | 5789 |
| PDH_1063 | KVGG | 4 | 5790 |
| PDH_1064 | TVAG | 4 | 5791 |
| PDH_1065 | AVTG | 4 | 5792 |
| PDH_1066 | KVRG | 4 | 5793 |
| PDH_1067 | LVTG | 4 | 5794 |
| PDH_1068 | AVRG | 4 | 5795 |
| PDH_1069 | LVGG | 4 | 5796 |
| PDH_1070 | AVAG | 4 | 4473 |
| PDH_1071 | QVAG | 4 | 5797 |
| PDH_1072 | KVTG | 4 | 5798 |
| PDH_1073 | TVTG | 4 | 5799 |
| PDH_1074 | VVGG | 4 | 5800 |
| PDH_1075 | KVAG | 4 | 5801 |
| PDH_1076 | MVAG | 4 | 5802 |
| PDH_1077 | VVTG | 4 | 5803 |
| PDH_1078 | TVRG | 4 | 5804 |
| PDH_1079 | SDGY | 4 | 5805 |
| PDH_1080 | IDGF | 4 | 5806 |
| PDH_1081 | ADGY | 4 | 5807 |
| PDH_1082 | ADGS | 4 | 5808 |
| PDH_1083 | RDGF | 4 | 5809 |
| PDH_1084 | IDGS | 4 | 5810 |
| PDH_1085 | GDGS | 4 | 5811 |
| PDH_1086 | LDGY | 4 | 5812 |
| PDH_1087 | GDGY | 4 | 5813 |
| PDH_1088 | IDGY | 4 | 5814 |
| PDH_1089 | SDGS | 4 | 5815 |
| PDH_1090 | SDGF | 4 | 5816 |
| PDH_1091 | VDGF | 4 | 5817 |
| PDH_1092 | GDGF | 4 | 5818 |
| PDH_1093 | TDGY | 4 | 5819 |
| PDH_1094 | RDGY | 4 | 4410 |
| PDH_1095 | VDGY | 4 | 5820 |
| PDH_1096 | TDGS | 4 | 5821 |
| PDH_1097 | RDGS | 4 | 5822 |
| PDH_1098 | LDGF | 4 | 5823 |
| PDH_1099 | VDGS | 4 | 5824 |
| PDH_1100 | ADGF | 4 | 5825 |
| PDH_1101 | LDGS | 4 | 5826 |
| PDH_1102 | PDGS | 4 | 5827 |
| PDH_1103 | PDGF | 4 | 5828 |
| PDH_1104 | PDGY | 4 | 5829 |
| PDH_1105 | TDGF | 4 | 5830 |
| PDH_1106 | NYGG | 4 | 5831 |
| PDH_1107 | TYGD | 4 | 5832 |
| PDH_1108 | LYGD | 4 | 5833 |
| PDH_1109 | FYGG | 4 | 5834 |
| PDH_1110 | SYGG | 4 | 5835 |
| PDH_1111 | TYGG | 4 | 5836 |
| PDH_1112 | LYGA | 4 | 5837 |
| PDH_1113 | SYGA | 4 | 5838 |
| PDH_1114 | LYGG | 4 | 5839 |
| PDH_1115 | VYGD | 4 | 5840 |
| PDH_1116 | SYGD | 4 | 5841 |
| PDH_1117 | AYGG | 4 | 5842 |
| PDH_1118 | VYGG | 4 | 5843 |
| PDH_1119 | HYGG | 4 | 5844 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1120 | FYGA | 4 | 5845 |
| PDH_1121 | NYGD | 4 | 5846 |
| PDH_1122 | TYGA | 4 | 5847 |
| PDH_1123 | FYGD | 4 | 5848 |
| PDH_1124 | IYGD | 4 | 5849 |
| PDH_1125 | DYGD | 4 | 4349 |
| PDH_1126 | PYGD | 4 | 5850 |
| PDH_1127 | DYGA | 4 | 5851 |
| PDH_1128 | HYGA | 4 | 5852 |
| PDH_1129 | PYGA | 4 | 5853 |
| PDH_1130 | PYGG | 4 | 5854 |
| PDH_1131 | HYGD | 4 | 5855 |
| PDH_1132 | AYGA | 4 | 5856 |
| PDH_1133 | VYGA | 4 | 5857 |
| PDH_1134 | YYGD | 4 | 5858 |
| PDH_1135 | AYGD | 4 | 5859 |
| PDH_1136 | NYGA | 4 | 5860 |
| PDH_1137 | YYGA | 4 | 5861 |
| PDH_1138 | YYGG | 4 | 5862 |
| PDH_1139 | IYGG | 4 | 5863 |
| PDH_1140 | IYGA | 4 | 5864 |
| PDH_1141 | DYGG | 4 | 4357 |
| PDH_1142 | LMAT | 4 | 5865 |
| PDH_1143 | VTAT | 4 | 5866 |
| PDH_1144 | KMAT | 4 | 5867 |
| PDH_1145 | QMAT | 4 | 5868 |
| PDH_1146 | ETAT | 4 | 5869 |
| PDH_1147 | TTAT | 4 | 5870 |
| PDH_1148 | TMAT | 4 | 5871 |
| PDH_1149 | PTAT | 4 | 5872 |
| PDH_1150 | VMAT | 4 | 5873 |
| PDH_1151 | LTAT | 4 | 5874 |
| PDH_1152 | KTAT | 4 | 5875 |
| PDH_1153 | MMAT | 4 | 5876 |
| PDH_1154 | ATAT | 4 | 5877 |
| PDH_1155 | QTAT | 4 | 5878 |
| PDH_1156 | PMAT | 4 | 5879 |
| PDH_1157 | MTAT | 4 | 5880 |
| PDH_1158 | EMAT | 4 | 4402 |
| PDH_1159 | AMAT | 4 | 5881 |
| PDH_1160 | TYSA | 4 | 5882 |
| PDH_1161 | LYSS | 4 | 5883 |
| PDH_1162 | LYST | 4 | 5884 |
| PDH_1163 | QYSS | 4 | 5885 |
| PDH_1164 | VYST | 4 | 5886 |
| PDH_1165 | VYSS | 4 | 5887 |
| PDH_1166 | AYSA | 4 | 5888 |
| PDH_1167 | PYSG | 4 | 5889 |
| PDH_1168 | PYST | 4 | 5890 |
| PDH_1169 | VYSA | 4 | 5891 |
| PDH_1170 | PYSS | 4 | 5892 |
| PDH_1171 | VYSG | 4 | 5893 |
| PDH_1172 | PYSA | 4 | 5894 |
| PDH_1173 | KYST | 4 | 5895 |
| PDH_1174 | QYST | 4 | 5896 |
| PDH_1175 | TYSG | 4 | 5897 |
| PDH_1176 | TYST | 4 | 5898 |
| PDH_1177 | QYSA | 4 | 5899 |
| PDH_1178 | AYSS | 4 | 5900 |
| PDH_1179 | TYSS | 4 | 5901 |
| PDH_1180 | IYSA | 4 | 5902 |
| PDH_1181 | AYST | 4 | 5903 |
| PDH_1182 | IYSG | 4 | 5904 |
| PDH_1183 | EYSS | 4 | 4479 |
| PDH_1184 | KYSG | 4 | 5905 |
| PDH_1185 | EYSA | 4 | 5906 |
| PDH_1186 | LYSG | 4 | 5907 |
| PDH_1187 | AYSG | 4 | 5908 |
| PDH_1188 | EYSG | 4 | 5909 |
| PDH_1189 | LYSA | 4 | 5910 |
| PDH_1190 | QYSG | 4 | 5911 |
| PDH_1191 | IYST | 4 | 5912 |
| PDH_1192 | EYST | 4 | 5913 |
| PDH_1193 | KYSS | 4 | 5914 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1194 | IYSS | 4 | 5915 |
| PDH_1195 | KYSA | 4 | 5916 |
| PDH_1196 | QWLS | 4 | 5917 |
| PDH_1197 | QWLL | 4 | 5918 |
| PDH_1198 | QWLP | 4 | 5919 |
| PDH_1199 | QWLD | 4 | 5920 |
| PDH_1200 | QWLY | 4 | 5921 |
| PDH_1201 | QWLA | 4 | 5922 |
| PDH_1202 | QWLV | 4 | 4475 |
| PDH_1203 | QWLH | 4 | 5923 |
| PDH_1204 | QWLF | 4 | 5924 |
| PDH_1205 | PVAD | 4 | 5925 |
| PDH_1206 | PVAA | 4 | 5926 |
| PDH_1207 | IVAA | 4 | 5927 |
| PDH_1208 | EVAA | 4 | 5928 |
| PDH_1209 | EVAV | 4 | 5929 |
| PDH_1210 | VVAA | 4 | 3802 |
| PDH_1211 | IVAD | 4 | 5930 |
| PDH_1212 | EVAD | 4 | 5931 |
| PDH_1213 | IVAG | 4 | 5932 |
| PDH_1214 | QVAD | 4 | 5933 |
| PDH_1215 | AVAA | 4 | 5934 |
| PDH_1216 | AVAV | 4 | 5935 |
| PDH_1217 | AVAD | 4 | 5936 |
| PDH_1218 | KVAA | 4 | 5937 |
| PDH_1219 | QVAA | 4 | 5938 |
| PDH_1220 | TVAV | 4 | 5939 |
| PDH_1221 | LVAD | 4 | 5940 |
| PDH_1222 | LVAA | 4 | 5941 |
| PDH_1223 | IVAV | 4 | 5942 |
| PDH_1224 | VVAD | 4 | 5943 |
| PDH_1225 | VVAV | 4 | 5944 |
| PDH_1226 | QVAV | 4 | 5945 |
| PDH_1227 | PVAV | 4 | 5946 |
| PDH_1228 | KVAV | 4 | 5947 |
| PDH_1229 | LVAV | 4 | 5948 |
| PDH_1230 | TVAD | 4 | 5949 |
| PDH_1231 | KVAD | 4 | 5950 |
| PDH_1232 | TVAA | 4 | 5951 |
| PDH_1233 | STVA | 4 | 5952 |
| PDH_1234 | STVK | 4 | 5953 |
| PDH_1235 | RTVA | 4 | 5954 |
| PDH_1236 | ITVT | 4 | 5955 |
| PDH_1237 | PTVA | 4 | 5956 |
| PDH_1238 | ATVT | 4 | 5957 |
| PDH_1239 | ATVK | 4 | 5958 |
| PDH_1240 | VTVK | 4 | 5959 |
| PDH_1241 | TTVK | 4 | 5960 |
| PDH_1242 | PTVE | 4 | 5961 |
| PDH_1243 | VTVT | 4 | 5962 |
| PDH_1244 | STVT | 4 | 5963 |
| PDH_1245 | VTVE | 4 | 5964 |
| PDH_1246 | TTVT | 4 | 4352 |
| PDH_1247 | LTVA | 4 | 5965 |
| PDH_1248 | RTVT | 4 | 5966 |
| PDH_1249 | LTVE | 4 | 5967 |
| PDH_1250 | TTVE | 4 | 5968 |
| PDH_1251 | RTVK | 4 | 5969 |
| PDH_1252 | VTVA | 4 | 5970 |
| PDH_1253 | STVE | 4 | 5971 |
| PDH_1254 | ATVA | 4 | 5972 |
| PDH_1255 | GTVE | 4 | 5973 |
| PDH_1256 | GTVA | 4 | 5974 |
| PDH_1257 | ITVE | 4 | 5975 |
| PDH_1258 | PTVT | 4 | 5976 |
| PDH_1259 | ITVA | 4 | 5977 |
| PDH_1260 | ATVE | 4 | 5978 |
| PDH_1261 | GTVK | 4 | 5979 |
| PDH_1262 | LTVK | 4 | 5980 |
| PDH_1263 | ITVK | 4 | 5981 |
| PDH_1264 | RTVE | 4 | 5982 |
| PDH_1265 | LTVT | 4 | 5983 |
| PDH_1266 | TTVA | 4 | 5984 |
| PDH_1267 | PTVK | 4 | 5985 |

TABLE 28-continued

Theoretical segment pool of unique DH polypeptide segments encoded by the degenerate oligonucleotides of Table 27.

| Name | Sequence | Length | SEQ ID NO |
|------|----------|--------|-----------|
| PDH_1268 | GTVT | 4 | 5986 |
| PDH_1269 | SSSA | 4 | 5987 |
| PDH_1270 | SSSS | 4 | 4480 |
| PDH_1271 | SSSL | 4 | 5988 |
| PDH_1272 | SSSW | 4 | 4443 |
| PDH_1273 | SSSR | 4 | 5989 |
| PDH_1274 | SSSV | 4 | 5990 |
| PDH_1275 | SSST | 4 | 5991 |
| PDH_1276 | SSSM | 4 | 5992 |
| PDH_1277 | SSSG | 4 | 5993 |
| PDH_1278 | LSYG | 4 | 5994 |
| PDH_1279 | PYYG | 4 | 5995 |
| PDH_1280 | ASYG | 4 | 5996 |
| PDH_1281 | FYYG | 4 | 5997 |
| PDH_1282 | DSYG | 4 | 5998 |
| PDH_1283 | VYYG | 4 | 5999 |
| PDH_1284 | IYYG | 4 | 6000 |
| PDH_1285 | DYYG | 4 | 6001 |
| PDH_1286 | HYYG | 4 | 6002 |
| PDH_1287 | SYYG | 4 | 6003 |
| PDH_1288 | YYYG | 4 | 3989 |
| PDH_1289 | VSYG | 4 | 6004 |
| PDH_1290 | NSYG | 4 | 6005 |
| PDH_1291 | SSYG | 4 | 6006 |
| PDH_1292 | FSYG | 4 | 6007 |
| PDH_1293 | ISYG | 4 | 6008 |
| PDH_1294 | TSYG | 4 | 6009 |
| PDH_1295 | LYYG | 4 | 6010 |
| PDH_1296 | PSYG | 4 | 6011 |
| PDH_1297 | AYYG | 4 | 6012 |
| PDH_1298 | YSYG | 4 | 4433 |
| PDH_1299 | HSYG | 4 | 6013 |
| PDH_1300 | NYYG | 4 | 6014 |
| PDH_1301 | TYYG | 4 | 6015 |
| PDH_1302 | FSWY | 4 | 6016 |
| PDH_1303 | SSWF | 4 | 6017 |
| PDH_1304 | DSWS | 4 | 6018 |
| PDH_1305 | LSWS | 4 | 6019 |
| PDH_1306 | DSWY | 4 | 6020 |
| PDH_1307 | LSWF | 4 | 6021 |
| PDH_1308 | LSWY | 4 | 6022 |
| PDH_1309 | VSWS | 4 | 6023 |
| PDH_1310 | HSWY | 4 | 6024 |
| PDH_1311 | SSWS | 4 | 6025 |
| PDH_1312 | PSWS | 4 | 6026 |
| PDH_1313 | SSWY | 4 | 4444 |
| PDH_1314 | FSWF | 4 | 6027 |
| PDH_1315 | FSWS | 4 | 6028 |
| PDH_1316 | PSWF | 4 | 6029 |
| PDH_1317 | VSWF | 4 | 6030 |
| PDH_1318 | HSWF | 4 | 6031 |
| PDH_1319 | VSWY | 4 | 6032 |
| PDH_1320 | HSWS | 4 | 6033 |
| PDH_1321 | DSWF | 4 | 6034 |
| PDH_1322 | PSWY | 4 | 6035 |
| PDH_1323 | ASWY | 4 | 6036 |
| PDH_1324 | YSWS | 4 | 6037 |
| PDH_1325 | ASWF | 4 | 6038 |
| PDH_1326 | ASWS | 4 | 6039 |
| PDH_1327 | YSWF | 4 | 6040 |
| PDH_1328 | YSWY | 4 | 6041 |
| PDH_1329 | IQLV | 4 | 6042 |
| PDH_1330 | AQLG | 4 | 6043 |
| PDH_1331 | IQLA | 4 | 6044 |
| PDH_1332 | EQLV | 4 | 6045 |
| PDH_1333 | AQLA | 4 | 6046 |
| PDH_1334 | IQLG | 4 | 6047 |
| PDH_1335 | KQLD | 4 | 6048 |
| PDH_1336 | TQLV | 4 | 6049 |
| PDH_1337 | QQLA | 4 | 6050 |
| PDH_1338 | AQLD | 4 | 6051 |
| PDH_1339 | IQLD | 4 | 6052 |
| PDH_1340 | AQLV | 4 | 6053 |
| PDH_1341 | KQLA | 4 | 6054 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1342 | KQLG | 4 | 6055 |
| PDH_1343 | LQLD | 4 | 6056 |
| PDH_1344 | LQLG | 4 | 6057 |
| PDH_1345 | TQLA | 4 | 6058 |
| PDH_1346 | VQLD | 4 | 6059 |
| PDH_1347 | TQLD | 4 | 6060 |
| PDH_1348 | VQLA | 4 | 6061 |
| PDH_1349 | EQLD | 4 | 6062 |
| PDH_1350 | VQLG | 4 | 6063 |
| PDH_1351 | TQLG | 4 | 6064 |
| PDH_1352 | PQLD | 4 | 6065 |
| PDH_1353 | QQLV | 4 | 4455 |
| PDH_1354 | QQLD | 4 | 6066 |
| PDH_1355 | PQLA | 4 | 6067 |
| PDH_1356 | PQLG | 4 | 6068 |
| PDH_1357 | VQLV | 4 | 6069 |
| PDH_1358 | QQLG | 4 | 6070 |
| PDH_1359 | KQLV | 4 | 6071 |
| PDH_1360 | LQLV | 4 | 6072 |
| PDH_1361 | LQLA | 4 | 6073 |
| PDH_1362 | EQLA | 4 | 6074 |
| PDH_1363 | PQLV | 4 | 6075 |
| PDH_1364 | EQLG | 4 | 6076 |
| PDH_1365 | DGSA | 4 | 6077 |
| PDH_1366 | DGSS | 4 | 6078 |
| PDH_1367 | SGSA | 4 | 6079 |
| PDH_1368 | DGSD | 4 | 6080 |
| PDH_1369 | SGSD | 4 | 6081 |
| PDH_1370 | PGSD | 4 | 6082 |
| PDH_1371 | FGSS | 4 | 6083 |
| PDH_1372 | HGSA | 4 | 6084 |
| PDH_1373 | YGSS | 4 | 6085 |
| PDH_1374 | FGSA | 4 | 6086 |
| PDH_1375 | FGSD | 4 | 6087 |
| PDH_1376 | LGSA | 4 | 6088 |
| PDH_1377 | LGSS | 4 | 6089 |
| PDH_1378 | AGSD | 4 | 6090 |
| PDH_1379 | VGSS | 4 | 6091 |
| PDH_1380 | AGSS | 4 | 6092 |
| PDH_1381 | HGSD | 4 | 6093 |
| PDH_1382 | VGSA | 4 | 6094 |
| PDH_1383 | YGSA | 4 | 6095 |
| PDH_1384 | YGSD | 4 | 6096 |
| PDH_1385 | AGSA | 4 | 6097 |
| PDH_1386 | HGSS | 4 | 6098 |
| PDH_1387 | VGSD | 4 | 6099 |
| PDH_1388 | PGSA | 4 | 6100 |
| PDH_1389 | PGSS | 4 | 6101 |
| PDH_1390 | SGSS | 4 | 6102 |
| PDH_1391 | LGSD | 4 | 6103 |
| PDH_1392 | SGWY | 4 | 4464 |
| PDH_1393 | PGWY | 4 | 6104 |
| PDH_1394 | FGWY | 4 | 6105 |
| PDH_1395 | YGWY | 4 | 6106 |
| PDH_1396 | AGWY | 4 | 6107 |
| PDH_1397 | VGWY | 4 | 6108 |
| PDH_1398 | LGWY | 4 | 6109 |
| PDH_1399 | DGWY | 4 | 6110 |
| PDH_1400 | HGWY | 4 | 6111 |
| PDH_1401 | PSGW | 4 | 6112 |
| PDH_1402 | YSGW | 4 | 6113 |
| PDH_1403 | FSGR | 4 | 6114 |
| PDH_1404 | VSGG | 4 | 6115 |
| PDH_1405 | NSGR | 4 | 6116 |
| PDH_1406 | DSGR | 4 | 6117 |
| PDH_1407 | ASGR | 4 | 6118 |
| PDH_1408 | FSGW | 4 | 6119 |
| PDH_1409 | DSGW | 4 | 6120 |
| PDH_1410 | VSGR | 4 | 6121 |
| PDH_1411 | ISGW | 4 | 6122 |
| PDH_1412 | LSGW | 4 | 6123 |
| PDH_1413 | DSGG | 4 | 3723 |
| PDH_1414 | HSGR | 4 | 6124 |
| PDH_1415 | NSGW | 4 | 6125 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1416 | HSGG | 4 | 6126 |
| PDH_1417 | HSGW | 4 | 6127 |
| PDH_1418 | ISGG | 4 | 6128 |
| PDH_1419 | YSGR | 4 | 6129 |
| PDH_1420 | ISGR | 4 | 6130 |
| PDH_1421 | YSGG | 4 | 6131 |
| PDH_1422 | NSGG | 4 | 6132 |
| PDH_1423 | SSGW | 4 | 4463 |
| PDH_1424 | VSGW | 4 | 6133 |
| PDH_1425 | SSGR | 4 | 6134 |
| PDH_1426 | LSGR | 4 | 6135 |
| PDH_1427 | PSGR | 4 | 6136 |
| PDH_1428 | FSGG | 4 | 6137 |
| PDH_1429 | TSGR | 4 | 6138 |
| PDH_1430 | TSGW | 4 | 6139 |
| PDH_1431 | ASGG | 4 | 6140 |
| PDH_1432 | LSGG | 4 | 6141 |
| PDH_1433 | ASGW | 4 | 6142 |
| PDH_1434 | PSGG | 4 | 6143 |
| PDH_1435 | TSGG | 4 | 6144 |
| PDH_1436 | SSGG | 4 | 6145 |
| PDH_1437 | VGYD | 4 | 6146 |
| PDH_1438 | AGYD | 4 | 6147 |
| PDH_1439 | DGYD | 4 | 6148 |
| PDH_1440 | AGYA | 4 | 6149 |
| PDH_1441 | DGYA | 4 | 6150 |
| PDH_1442 | FGYA | 4 | 6151 |
| PDH_1443 | FGYD | 4 | 6152 |
| PDH_1444 | PGYA | 4 | 6153 |
| PDH_1445 | DGYS | 4 | 6154 |
| PDH_1446 | YGYA | 4 | 6155 |
| PDH_1447 | FGYS | 4 | 6156 |
| PDH_1448 | VGYA | 4 | 6157 |
| PDH_1449 | PGYD | 4 | 6158 |
| PDH_1450 | PGYS | 4 | 6159 |
| PDH_1451 | VGYS | 4 | 6160 |
| PDH_1452 | YGYD | 4 | 6161 |
| PDH_1453 | HGYA | 4 | 6162 |
| PDH_1454 | YGYS | 4 | 6163 |
| PDH_1455 | HGYD | 4 | 6164 |
| PDH_1456 | SGYS | 4 | 6165 |
| PDH_1457 | LGYA | 4 | 6166 |
| PDH_1458 | HGYS | 4 | 6167 |
| PDH_1459 | LGYD | 4 | 6168 |
| PDH_1460 | AGYS | 4 | 6169 |
| PDH_1461 | LGYS | 4 | 6170 |
| PDH_1462 | SGYD | 4 | 4393 |
| PDH_1463 | SGYA | 4 | 6171 |
| PDH_1464 | QVTA | 4 | 6172 |
| PDH_1465 | PVTA | 4 | 6173 |
| PDH_1466 | LVTT | 4 | 6174 |
| PDH_1467 | PVTT | 4 | 6175 |
| PDH_1468 | PVTE | 4 | 6176 |
| PDH_1469 | QVTT | 4 | 6177 |
| PDH_1470 | AVTA | 4 | 6178 |
| PDH_1471 | QVTK | 4 | 6179 |
| PDH_1472 | IVTA | 4 | 6180 |
| PDH_1473 | PVTK | 4 | 6181 |
| PDH_1474 | LVTK | 4 | 6182 |
| PDH_1475 | AVTE | 4 | 6183 |
| PDH_1476 | LVTA | 4 | 6184 |
| PDH_1477 | EVTA | 4 | 6185 |
| PDH_1478 | LVTE | 4 | 6186 |
| PDH_1479 | EVTE | 4 | 6187 |
| PDH_1480 | IVTE | 4 | 6188 |
| PDH_1481 | VVTA | 4 | 3906 |
| PDH_1482 | TVTK | 4 | 6189 |
| PDH_1483 | TVTT | 4 | 4353 |
| PDH_1484 | IVTT | 4 | 6190 |
| PDH_1485 | VVTE | 4 | 6191 |
| PDH_1486 | IVTK | 4 | 6192 |
| PDH_1487 | TVTE | 4 | 6193 |
| PDH_1488 | AVTT | 4 | 6194 |
| PDH_1489 | KVTA | 4 | 6195 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1490 | KVTE | 4 | 6196 |
| PDH_1491 | AVTK | 4 | 6197 |
| PDH_1492 | EVTK | 4 | 6198 |
| PDH_1493 | KVTK | 4 | 6199 |
| PDH_1494 | VVTK | 4 | 6200 |
| PDH_1495 | TVTA | 4 | 6201 |
| PDH_1496 | QVTE | 4 | 6202 |
| PDH_1497 | VVTT | 4 | 6203 |
| PDH_1498 | EVTT | 4 | 6204 |
| PDH_1499 | KVTT | 4 | 6205 |
| PDH_1500 | AAAG | 4 | 4453 |
| PDH_1501 | AAAS | 4 | 6206 |
| PDH_1502 | AAAL | 4 | 6207 |
| PDH_1503 | AAAR | 4 | 6208 |
| PDH_1504 | AAAI | 4 | 6209 |
| PDH_1505 | AAAV | 4 | 6210 |
| PDH_1506 | AAAP | 4 | 6211 |
| PDH_1507 | AAAA | 4 | 6212 |
| PDH_1508 | AIFG | 4 | 6213 |
| PDH_1509 | ATFG | 4 | 6214 |
| PDH_1510 | PTFG | 4 | 6215 |
| PDH_1511 | TTFG | 4 | 6216 |
| PDH_1512 | ITFG | 4 | 4153 |
| PDH_1513 | RTFG | 4 | 6217 |
| PDH_1514 | STFG | 4 | 6218 |
| PDH_1515 | SIFG | 4 | 6219 |
| PDH_1516 | LIFG | 4 | 6220 |
| PDH_1517 | RIFG | 4 | 6221 |
| PDH_1518 | TIFG | 4 | 4291 |
| PDH_1519 | GIFG | 4 | 6222 |
| PDH_1520 | IIFG | 4 | 6223 |
| PDH_1521 | LTFG | 4 | 6224 |
| PDH_1522 | VIFG | 4 | 6225 |
| PDH_1523 | PIFG | 4 | 6226 |
| PDH_1524 | GTFG | 4 | 6227 |
| PDH_1525 | VTFG | 4 | 6228 |
| PDH_1526 | VAAK | 4 | 6229 |
| PDH_1527 | VAAL | 4 | 6230 |
| PDH_1528 | VAAP | 4 | 6231 |
| PDH_1529 | VAAQ | 4 | 6232 |
| PDH_1530 | VAAA | 4 | 6233 |
| PDH_1531 | VAAE | 4 | 6234 |
| PDH_1532 | VAAV | 4 | 6235 |
| PDH_1533 | VAAI | 4 | 6236 |
| PDH_1534 | YYYD | 4 | 4182 |
| PDH_1535 | VYYA | 4 | 6237 |
| PDH_1536 | AYYD | 4 | 6238 |
| PDH_1537 | YYYA | 4 | 6239 |
| PDH_1538 | PYYD | 4 | 6240 |
| PDH_1539 | IYYD | 4 | 6241 |
| PDH_1540 | VYYD | 4 | 6242 |
| PDH_1541 | IYYA | 4 | 6243 |
| PDH_1542 | TYYA | 4 | 6244 |
| PDH_1543 | LYYD | 4 | 6245 |
| PDH_1544 | DYYD | 4 | 6246 |
| PDH_1545 | SYYD | 4 | 6247 |
| PDH_1546 | LYYA | 4 | 6248 |
| PDH_1547 | HYYA | 4 | 6249 |
| PDH_1548 | DYYA | 4 | 6250 |
| PDH_1549 | SYYA | 4 | 6251 |
| PDH_1550 | FYYD | 4 | 6252 |
| PDH_1551 | FYYA | 4 | 6253 |
| PDH_1552 | PYYA | 4 | 6254 |
| PDH_1553 | AYYA | 4 | 6255 |
| PDH_1554 | HYYD | 4 | 6256 |
| PDH_1555 | NYYA | 4 | 6257 |
| PDH_1556 | TYYD | 4 | 6258 |
| PDH_1557 | NYYD | 4 | 6259 |
| PDH_1558 | GYGY | 4 | 6260 |
| PDH_1559 | LYGY | 4 | 6261 |
| PDH_1560 | SSGY | 4 | 4186 |
| PDH_1561 | RYGY | 4 | 6262 |
| PDH_1562 | TYGY | 4 | 6263 |
| PDH_1563 | TSGY | 4 | 6264 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1564 | VYGY | 4 | 6265 |
| PDH_1565 | ISGY | 4 | 6266 |
| PDH_1566 | ASGY | 4 | 6267 |
| PDH_1567 | PSGY | 4 | 6268 |
| PDH_1568 | RSGY | 4 | 6269 |
| PDH_1569 | GAGY | 4 | 6270 |
| PDH_1570 | AAGY | 4 | 6271 |
| PDH_1571 | LSGY | 4 | 6272 |
| PDH_1572 | SYGY | 4 | 4434 |
| PDH_1573 | VSGY | 4 | 6273 |
| PDH_1574 | VAGY | 4 | 6274 |
| PDH_1575 | TAGY | 4 | 6275 |
| PDH_1576 | PAGY | 4 | 6276 |
| PDH_1577 | SAGY | 4 | 6277 |
| PDH_1578 | RAGY | 4 | 6278 |
| PDH_1579 | IAGY | 4 | 6279 |
| PDH_1580 | AYGY | 4 | 6280 |
| PDH_1581 | PYGY | 4 | 6281 |
| PDH_1582 | LAGY | 4 | 6282 |
| PDH_1583 | IYGY | 4 | 6283 |
| PDH_1584 | GSGY | 4 | 6284 |
| PDH_1585 | LQLL | 4 | 6285 |
| PDH_1586 | AQLW | 4 | 6286 |
| PDH_1587 | TQLW | 4 | 6287 |
| PDH_1588 | QQLL | 4 | 6288 |
| PDH_1589 | IQLW | 4 | 4427 |
| PDH_1590 | EQLL | 4 | 6289 |
| PDH_1591 | QQLW | 4 | 6290 |
| PDH_1592 | IQLL | 4 | 6291 |
| PDH_1593 | EQLW | 4 | 6292 |
| PDH_1594 | VQLW | 4 | 6293 |
| PDH_1595 | KQLW | 4 | 6294 |
| PDH_1596 | KQLL | 4 | 6295 |
| PDH_1597 | PQLW | 4 | 6296 |
| PDH_1598 | VQLL | 4 | 6297 |
| PDH_1599 | TQLL | 4 | 6298 |
| PDH_1600 | PQLL | 4 | 6299 |
| PDH_1601 | LQLW | 4 | 6300 |
| PDH_1602 | AQLL | 4 | 6301 |
| PDH_1603 | LGVA | 4 | 6302 |
| PDH_1604 | LGGA | 4 | 6303 |
| PDH_1605 | KGIA | 4 | 6304 |
| PDH_1606 | KGSA | 4 | 6305 |
| PDH_1607 | VGIA | 4 | 6306 |
| PDH_1608 | KGGA | 4 | 6307 |
| PDH_1609 | MGGA | 4 | 6308 |
| PDH_1610 | TGGA | 4 | 6309 |
| PDH_1611 | QGSA | 4 | 6310 |
| PDH_1612 | QGIA | 4 | 6311 |
| PDH_1613 | EGSA | 4 | 6312 |
| PDH_1614 | PGVA | 4 | 6313 |
| PDH_1615 | QGVA | 4 | 6314 |
| PDH_1616 | EGIA | 4 | 6315 |
| PDH_1617 | AGVA | 4 | 6316 |
| PDH_1618 | MGVA | 4 | 6317 |
| PDH_1619 | EGGA | 4 | 3671 |
| PDH_1620 | PGIA | 4 | 6318 |
| PDH_1621 | AGGA | 4 | 6319 |
| PDH_1622 | VGGA | 4 | 6320 |
| PDH_1623 | EGVA | 4 | 6321 |
| PDH_1624 | PGGA | 4 | 6322 |
| PDH_1625 | QGGA | 4 | 6323 |
| PDH_1626 | AGIA | 4 | 6324 |
| PDH_1627 | LGIA | 4 | 6325 |
| PDH_1628 | MGIA | 4 | 6326 |
| PDH_1629 | TGSA | 4 | 6327 |
| PDH_1630 | TGIA | 4 | 6328 |
| PDH_1631 | MGSA | 4 | 6329 |
| PDH_1632 | KGVA | 4 | 6330 |
| PDH_1633 | TGVA | 4 | 6331 |
| PDH_1634 | VGVA | 4 | 6332 |
| PDH_1635 | PFGE | 4 | 6333 |
| PDH_1636 | VVGE | 4 | 6334 |
| PDH_1637 | ALGE | 4 | 6335 |

TABLE 28-continued

Theoretical segment pool of unique DH polypeptide segments encoded by the degenerate oligonucleotides of Table 27.

| Name | Sequence | Length | SEQ ID NO |
|------|----------|--------|-----------|
| PDH_1638 | IFGE | 4 | 6336 |
| PDH_1639 | PLGE | 4 | 6337 |
| PDH_1640 | ILGE | 4 | 6338 |
| PDH_1641 | PVGE | 4 | 6339 |
| PDH_1642 | RVGE | 4 | 6340 |
| PDH_1643 | LLGE | 4 | 6341 |
| PDH_1644 | SVGE | 4 | 6342 |
| PDH_1645 | GLGE | 4 | 6343 |
| PDH_1646 | IVGE | 4 | 6344 |
| PDH_1647 | RLGE | 4 | 4068 |
| PDH_1648 | LVGE | 4 | 6345 |
| PDH_1649 | SLGE | 4 | 6346 |
| PDH_1650 | TLGE | 4 | 6347 |
| PDH_1651 | VLGE | 4 | 6348 |
| PDH_1652 | TVGE | 4 | 6349 |
| PDH_1653 | GVGE | 4 | 6350 |
| PDH_1654 | AVGE | 4 | 6351 |
| PDH_1655 | PYSY | 4 | 6352 |
| PDH_1656 | PYSD | 4 | 6353 |
| PDH_1657 | DYSD | 4 | 6354 |
| PDH_1658 | DYSA | 4 | 6355 |
| PDH_1659 | SYSD | 4 | 6356 |
| PDH_1660 | FYSY | 4 | 6357 |
| PDH_1661 | VYSY | 4 | 6358 |
| PDH_1662 | FYSS | 4 | 6359 |
| PDH_1663 | SYSS | 4 | 6360 |
| PDH_1664 | YYSS | 4 | 6361 |
| PDH_1665 | YYSY | 4 | 6362 |
| PDH_1666 | AYSY | 4 | 6363 |
| PDH_1667 | AYSD | 4 | 6364 |
| PDH_1668 | HYSY | 4 | 6365 |
| PDH_1669 | VYSD | 4 | 6366 |
| PDH_1670 | FYSA | 4 | 6367 |
| PDH_1671 | SYSY | 4 | 6368 |
| PDH_1672 | SYSA | 4 | 6369 |
| PDH_1673 | FYSD | 4 | 6370 |
| PDH_1674 | YYSD | 4 | 6371 |
| PDH_1675 | LYSY | 4 | 6372 |
| PDH_1676 | YYSA | 4 | 6373 |
| PDH_1677 | HYSS | 4 | 6374 |
| PDH_1678 | DYSS | 4 | 6375 |
| PDH_1679 | HYSA | 4 | 6376 |
| PDH_1680 | DYSY | 4 | 6377 |
| PDH_1681 | HYSD | 4 | 6378 |
| PDH_1682 | LYSD | 4 | 6379 |
| PDH_1683 | AVPA | 4 | 6380 |
| PDH_1684 | AVRA | 4 | 6381 |
| PDH_1685 | PVRA | 4 | 6382 |
| PDH_1686 | PVPA | 4 | 6383 |
| PDH_1687 | IVGA | 4 | 3755 |
| PDH_1688 | EVPA | 4 | 6384 |
| PDH_1689 | LVGA | 4 | 6385 |
| PDH_1690 | IVRA | 4 | 6386 |
| PDH_1691 | QVGA | 4 | 6387 |
| PDH_1692 | IVPA | 4 | 6388 |
| PDH_1693 | EVGA | 4 | 6389 |
| PDH_1694 | LVPA | 4 | 6390 |
| PDH_1695 | QVPA | 4 | 6391 |
| PDH_1696 | AVGA | 4 | 6392 |
| PDH_1697 | QVRA | 4 | 6393 |
| PDH_1698 | TVRA | 4 | 6394 |
| PDH_1699 | KVGA | 4 | 6395 |
| PDH_1700 | VVPA | 4 | 3837 |
| PDH_1701 | VVGA | 4 | 6396 |
| PDH_1702 | EVRA | 4 | 6397 |
| PDH_1703 | LVRA | 4 | 6398 |
| PDH_1704 | VVRA | 4 | 6399 |
| PDH_1705 | PVGA | 4 | 6400 |
| PDH_1706 | TVGA | 4 | 6401 |
| PDH_1707 | KVRA | 4 | 6402 |
| PDH_1708 | KVPA | 4 | 6403 |
| PDH_1709 | TVPA | 4 | 6404 |
| PDH_1710 | GRGV | 4 | 6405 |
| PDH_1711 | SRGV | 4 | 6406 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1712 | ILGV | 4 | 6407 |
| PDH_1713 | AQGV | 4 | 6408 |
| PDH_1714 | TQGV | 4 | 6409 |
| PDH_1715 | VQGV | 4 | 4062 |
| PDH_1716 | PQGV | 4 | 6410 |
| PDH_1717 | SQGV | 4 | 6411 |
| PDH_1718 | RRGV | 4 | 6412 |
| PDH_1719 | PLGV | 4 | 6413 |
| PDH_1720 | PRGV | 4 | 6414 |
| PDH_1721 | IRGV | 4 | 6415 |
| PDH_1722 | ALGV | 4 | 6416 |
| PDH_1723 | VRGV | 4 | 4018 |
| PDH_1724 | TRGV | 4 | 6417 |
| PDH_1725 | TLGV | 4 | 6418 |
| PDH_1726 | GQGV | 4 | 6419 |
| PDH_1727 | RQGV | 4 | 6420 |
| PDH_1728 | ARGV | 4 | 4812 |
| PDH_1729 | RLGV | 4 | 6421 |
| PDH_1730 | LRGV | 4 | 6422 |
| PDH_1731 | SLGV | 4 | 6423 |
| PDH_1732 | VLGV | 4 | 6424 |
| PDH_1733 | IQGV | 4 | 6425 |
| PDH_1734 | LLGV | 4 | 6426 |
| PDH_1735 | LQGV | 4 | 6427 |
| PDH_1736 | GLGV | 4 | 6428 |
| PDH_1737 | DSSW | 4 | 6429 |
| PDH_1738 | DSSR | 4 | 6430 |
| PDH_1739 | DSSV | 4 | 6431 |
| PDH_1740 | DSST | 4 | 6432 |
| PDH_1741 | DSSM | 4 | 6433 |
| PDH_1742 | DSSG | 4 | 4185 |
| PDH_1743 | DSSA | 4 | 6434 |
| PDH_1744 | DSSS | 4 | 6435 |
| PDH_1745 | DSSL | 4 | 6436 |
| PDH_1746 | TGYS | 4 | 6437 |
| PDH_1747 | SDYS | 4 | 6438 |
| PDH_1748 | LAYS | 4 | 6439 |
| PDH_1749 | VDYS | 4 | 6440 |
| PDH_1750 | LDYS | 4 | 6441 |
| PDH_1751 | PDYS | 4 | 6442 |
| PDH_1752 | SAYS | 4 | 6443 |
| PDH_1753 | TDYS | 4 | 6444 |
| PDH_1754 | LAYS | 4 | 6445 |
| PDH_1755 | GAYS | 4 | 6446 |
| PDH_1756 | GDYS | 4 | 6447 |
| PDH_1757 | VAYS | 4 | 6448 |
| PDH_1758 | RDYS | 4 | 6449 |
| PDH_1759 | IDYS | 4 | 6450 |
| PDH_1760 | RAYS | 4 | 6451 |
| PDH_1761 | PAYS | 4 | 6452 |
| PDH_1762 | ADYS | 4 | 6453 |
| PDH_1763 | TAYS | 4 | 6454 |
| PDH_1764 | IGYS | 4 | 6455 |
| PDH_1765 | GGYS | 4 | 6456 |
| PDH_1766 | RGYS | 4 | 6457 |
| PDH_1767 | AAYS | 4 | 6458 |
| PDH_1768 | LYGS | 4 | 6459 |
| PDH_1769 | TYGS | 4 | 6460 |
| PDH_1770 | DYGS | 4 | 6461 |
| PDH_1771 | SYGS | 4 | 6462 |
| PDH_1772 | FYGS | 4 | 6463 |
| PDH_1773 | YYGS | 4 | 3990 |
| PDH_1774 | NYGS | 4 | 6464 |
| PDH_1775 | HYGS | 4 | 6465 |
| PDH_1776 | VYGS | 4 | 6466 |
| PDH_1777 | AYGS | 4 | 6467 |
| PDH_1778 | PYGS | 4 | 6468 |
| PDH_1779 | IYGS | 4 | 6469 |
| PDH_1780 | YYYS | 4 | 6470 |
| PDH_1781 | SYYS | 4 | 6471 |
| PDH_1782 | YYYY | 4 | 6472 |
| PDH_1783 | PYYF | 4 | 6473 |
| PDH_1784 | FYYS | 4 | 6474 |
| PDH_1785 | NYYS | 4 | 6475 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1786 | NYYF | 4 | 6476 |
| PDH_1787 | FYYF | 4 | 6477 |
| PDH_1788 | FYYY | 4 | 6478 |
| PDH_1789 | AYYY | 4 | 6479 |
| PDH_1790 | SYYY | 4 | 6480 |
| PDH_1791 | DYYY | 4 | 6481 |
| PDH_1792 | AYYS | 4 | 6482 |
| PDH_1793 | IYYY | 4 | 6483 |
| PDH_1794 | LYYY | 4 | 6484 |
| PDH_1795 | DYYS | 4 | 6485 |
| PDH_1796 | AYYF | 4 | 6486 |
| PDH_1797 | PYYS | 4 | 6487 |
| PDH_1798 | IYYS | 4 | 6488 |
| PDH_1799 | YYYF | 4 | 6489 |
| PDH_1800 | HYYS | 4 | 6490 |
| PDH_1801 | PYYY | 4 | 6491 |
| PDH_1802 | HYYF | 4 | 6492 |
| PDH_1803 | HYYY | 4 | 6493 |
| PDH_1804 | LYYS | 4 | 6494 |
| PDH_1805 | VYYF | 4 | 6495 |
| PDH_1806 | SYYF | 4 | 6496 |
| PDH_1807 | IYYF | 4 | 6497 |
| PDH_1808 | LYYF | 4 | 6498 |
| PDH_1809 | DYYF | 4 | 6499 |
| PDH_1810 | TYYS | 4 | 6500 |
| PDH_1811 | NYYY | 4 | 6501 |
| PDH_1812 | TYYF | 4 | 6502 |
| PDH_1813 | TYYY | 4 | 6503 |
| PDH_1814 | VYYS | 4 | 6504 |
| PDH_1815 | VYYY | 4 | 6505 |
| PDH_1816 | FSYS | 4 | 6506 |
| PDH_1817 | VRYS | 4 | 6507 |
| PDH_1818 | YSYS | 4 | 6508 |
| PDH_1819 | LRYS | 4 | 6509 |
| PDH_1820 | ARYS | 4 | 6510 |
| PDH_1821 | FRYS | 4 | 6511 |
| PDH_1822 | SRYS | 4 | 6512 |
| PDH_1823 | DSYS | 4 | 6513 |
| PDH_1824 | LSYS | 4 | 6514 |
| PDH_1825 | HRYS | 4 | 6515 |
| PDH_1826 | PSYS | 4 | 6516 |
| PDH_1827 | HSYS | 4 | 6517 |
| PDH_1828 | ASYS | 4 | 6518 |
| PDH_1829 | YRYS | 4 | 6519 |
| PDH_1830 | SSYS | 4 | 6520 |
| PDH_1831 | PRYS | 4 | 6521 |
| PDH_1832 | VSYS | 4 | 6522 |
| PDH_1833 | DRYS | 4 | 6523 |
| PDH_1834 | TWFG | 4 | 6524 |
| PDH_1835 | GWFG | 4 | 6525 |
| PDH_1836 | RWFG | 4 | 6526 |
| PDH_1837 | PWFG | 4 | 6527 |
| PDH_1838 | LWFG | 4 | 3965 |
| PDH_1839 | VWFG | 4 | 6528 |
| PDH_1840 | SWFG | 4 | 6529 |
| PDH_1841 | AWFG | 4 | 6530 |
| PDH_1842 | IWFG | 4 | 6531 |
| PDH_1843 | RYYY | 4 | 6532 |
| PDH_1844 | RYYS | 4 | 6533 |
| PDH_1845 | RYYF | 4 | 6534 |
| PDH_1846 | GYYF | 4 | 6535 |
| PDH_1847 | GYYS | 4 | 6536 |
| PDH_1848 | GYYY | 4 | 4188 |
| PDH_1849 | KFGG | 4 | 6537 |
| PDH_1850 | ALGG | 4 | 6538 |
| PDH_1851 | ILGG | 4 | 6539 |
| PDH_1852 | EFGG | 4 | 6540 |
| PDH_1853 | QFGG | 4 | 6541 |
| PDH_1854 | PLGG | 4 | 6542 |
| PDH_1855 | VLGG | 4 | 6543 |
| PDH_1856 | IVGG | 4 | 6544 |
| PDH_1857 | LLGG | 4 | 6545 |
| PDH_1858 | QLGG | 4 | 6546 |
| PDH_1859 | KLGG | 4 | 6547 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1860 | IFGG | 4 | 6548 |
| PDH_1861 | ELGG | 4 | 3713 |
| PDH_1862 | PFGG | 4 | 6549 |
| PDH_1863 | TLGG | 4 | 6550 |
| PDH_1864 | YMVRD | 5 | 6551 |
| PDH_1865 | SMVRG | 5 | 6552 |
| PDH_1866 | FMVRD | 5 | 6553 |
| PDH_1867 | FMVRA | 5 | 6554 |
| PDH_1868 | DMVRA | 5 | 6555 |
| PDH_1869 | HMVRG | 5 | 6556 |
| PDH_1870 | LMVRG | 5 | 6557 |
| PDH_1871 | DMVRD | 5 | 6558 |
| PDH_1872 | LMVRA | 5 | 6559 |
| PDH_1873 | DMVRG | 5 | 6560 |
| PDH_1874 | AMVRA | 5 | 6561 |
| PDH_1875 | AMVRD | 5 | 6562 |
| PDH_1876 | NMVRA | 5 | 6563 |
| PDH_1877 | NMVRG | 5 | 6564 |
| PDH_1878 | FMVRG | 5 | 6565 |
| PDH_1879 | SMVRD | 5 | 6566 |
| PDH_1880 | YMVRA | 5 | 6567 |
| PDH_1881 | SMVRA | 5 | 6568 |
| PDH_1882 | PMVRD | 5 | 6569 |
| PDH_1883 | YMVRG | 5 | 6570 |
| PDH_1884 | TMVRG | 5 | 4010 |
| PDH_1885 | PMVRA | 5 | 6571 |
| PDH_1886 | PMVRG | 5 | 6572 |
| PDH_1887 | VMVRA | 5 | 6573 |
| PDH_1888 | NMVRD | 5 | 6574 |
| PDH_1889 | VMVRG | 5 | 6575 |
| PDH_1890 | TMVRD | 5 | 6576 |
| PDH_1891 | VMVRD | 5 | 6577 |
| PDH_1892 | TMVRA | 5 | 6578 |
| PDH_1893 | AMVRG | 5 | 6579 |
| PDH_1894 | LMVRD | 5 | 6580 |
| PDH_1895 | HMVRD | 5 | 6581 |
| PDH_1896 | HMVRA | 5 | 6582 |
| PDH_1897 | IMVRD | 5 | 6583 |
| PDH_1898 | IMVRA | 5 | 6584 |
| PDH_1899 | IMVRG | 5 | 6585 |
| PDH_1900 | AYGDF | 5 | 6586 |
| PDH_1901 | VYGDS | 5 | 6587 |
| PDH_1902 | DYGDY | 5 | 4348 |
| PDH_1903 | NYGDF | 5 | 6588 |
| PDH_1904 | DYGDS | 5 | 6589 |
| PDH_1905 | HYGDS | 5 | 6590 |
| PDH_1906 | HYGDY | 5 | 6591 |
| PDH_1907 | IYGDS | 5 | 6592 |
| PDH_1908 | LYGDS | 5 | 6593 |
| PDH_1909 | LYGDF | 5 | 6594 |
| PDH_1910 | AYGDY | 5 | 6595 |
| PDH_1911 | AYGDS | 5 | 6596 |
| PDH_1912 | SYGDS | 5 | 6597 |
| PDH_1913 | SYGDY | 5 | 6598 |
| PDH_1914 | NYGDS | 5 | 6599 |
| PDH_1915 | HYGDF | 5 | 6600 |
| PDH_1916 | FYGDS | 5 | 6601 |
| PDH_1917 | IYGDF | 5 | 6602 |
| PDH_1918 | FYGDY | 5 | 6603 |
| PDH_1919 | VYGDY | 5 | 6604 |
| PDH_1920 | NYGDY | 5 | 6605 |
| PDH_1921 | YYGDS | 5 | 6606 |
| PDH_1922 | YYGDF | 5 | 6607 |
| PDH_1923 | PYGDY | 5 | 6608 |
| PDH_1924 | SYGDF | 5 | 6609 |
| PDH_1925 | TYGDS | 5 | 6610 |
| PDH_1926 | TYGDY | 5 | 6611 |
| PDH_1927 | LYGDY | 5 | 6612 |
| PDH_1928 | DYGDF | 5 | 6613 |
| PDH_1929 | IYGDY | 5 | 6614 |
| PDH_1930 | VYGDF | 5 | 6615 |
| PDH_1931 | FYGDF | 5 | 6616 |
| PDH_1932 | TYGDF | 5 | 6617 |
| PDH_1933 | PYGDF | 5 | 6618 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_1934 | PYGDS | 5 | 6619 |
| PDH_1935 | YYGDY | 5 | 6620 |
| PDH_1936 | TYSYD | 5 | 6621 |
| PDH_1937 | PYSYG | 5 | 6622 |
| PDH_1938 | RYSYD | 5 | 6623 |
| PDH_1939 | AYSYV | 5 | 6624 |
| PDH_1940 | PYSYA | 5 | 6625 |
| PDH_1941 | TYSYV | 5 | 6626 |
| PDH_1942 | PYSYD | 5 | 6627 |
| PDH_1943 | TYSYG | 5 | 6628 |
| PDH_1944 | AYSYD | 5 | 6629 |
| PDH_1945 | RYSYA | 5 | 6630 |
| PDH_1946 | PYSYV | 5 | 6631 |
| PDH_1947 | GYSYG | 5 | 4430 |
| PDH_1948 | GYSYA | 5 | 6632 |
| PDH_1949 | GYSYD | 5 | 6633 |
| PDH_1950 | GYSYV | 5 | 6634 |
| PDH_1951 | LYSYG | 5 | 6635 |
| PDH_1952 | SYSYV | 5 | 6636 |
| PDH_1953 | LYSYA | 5 | 6637 |
| PDH_1954 | LYSYD | 5 | 6638 |
| PDH_1955 | RYSYV | 5 | 6639 |
| PDH_1956 | IYSYD | 5 | 6640 |
| PDH_1957 | VYSYV | 5 | 6641 |
| PDH_1958 | IYSYG | 5 | 6642 |
| PDH_1959 | IYSYA | 5 | 6643 |
| PDH_1960 | IYSYV | 5 | 6644 |
| PDH_1961 | RYSYG | 5 | 6645 |
| PDH_1962 | VYSYA | 5 | 6646 |
| PDH_1963 | AYSYA | 5 | 6647 |
| PDH_1964 | SYSYA | 5 | 6648 |
| PDH_1965 | VYSYG | 5 | 6649 |
| PDH_1966 | AYSYG | 5 | 6650 |
| PDH_1967 | VYSYD | 5 | 6651 |
| PDH_1968 | TYSYA | 5 | 6652 |
| PDH_1969 | SYSYD | 5 | 6653 |
| PDH_1970 | SYSYG | 5 | 6654 |
| PDH_1971 | LYSYV | 5 | 6655 |
| PDH_1972 | GSGSS | 5 | 6656 |
| PDH_1973 | GSGSF | 5 | 6657 |
| PDH_1974 | ASGSS | 5 | 6658 |
| PDH_1975 | RSGSY | 5 | 6659 |
| PDH_1976 | NSGSY | 5 | 6660 |
| PDH_1977 | NSGSS | 5 | 6661 |
| PDH_1978 | TSGSS | 5 | 6662 |
| PDH_1979 | RSGSS | 5 | 6663 |
| PDH_1980 | SSGSY | 5 | 6664 |
| PDH_1981 | VSGSF | 5 | 6665 |
| PDH_1982 | HSGSY | 5 | 6666 |
| PDH_1983 | TSGSY | 5 | 6667 |
| PDH_1984 | SSGSF | 5 | 6668 |
| PDH_1985 | LSGSF | 5 | 6669 |
| PDH_1986 | NSGSF | 5 | 6670 |
| PDH_1987 | PSGSY | 5 | 6671 |
| PDH_1988 | TSGSF | 5 | 6672 |
| PDH_1989 | PSGSS | 5 | 6673 |
| PDH_1990 | PSGSF | 5 | 6674 |
| PDH_1991 | GSGSY | 5 | 3987 |
| PDH_1992 | ISGSS | 5 | 6675 |
| PDH_1993 | ISGSY | 5 | 6676 |
| PDH_1994 | ASGSY | 5 | 6677 |
| PDH_1995 | RSGSF | 5 | 6678 |
| PDH_1996 | DSGSS | 5 | 6679 |
| PDH_1997 | DSGSY | 5 | 6680 |
| PDH_1998 | LSGSS | 5 | 6681 |
| PDH_1999 | SSGSS | 5 | 6682 |
| PDH_2000 | HSGSF | 5 | 6683 |
| PDH_2001 | HSGSS | 5 | 6684 |
| PDH_2002 | LSGSY | 5 | 6685 |
| PDH_2003 | ASGSF | 5 | 6686 |
| PDH_2004 | VSGSY | 5 | 6687 |
| PDH_2005 | ISGSF | 5 | 6688 |
| PDH_2006 | VSGSS | 5 | 6689 |
| PDH_2007 | DSGSF | 5 | 6690 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2008 | IFLES | 5 | 6691 |
| PDH_2009 | IFLEL | 5 | 6692 |
| PDH_2010 | RFLES | 5 | 6693 |
| PDH_2011 | LFLEL | 5 | 6694 |
| PDH_2012 | TFLES | 5 | 6695 |
| PDH_2013 | GFLEW | 5 | 6696 |
| PDH_2014 | GFLES | 5 | 6697 |
| PDH_2015 | TFLEW | 5 | 6698 |
| PDH_2016 | TFLEL | 5 | 6699 |
| PDH_2017 | VFLEW | 5 | 6700 |
| PDH_2018 | SFLEL | 5 | 6701 |
| PDH_2019 | VFLES | 5 | 6702 |
| PDH_2020 | GFLEL | 5 | 6703 |
| PDH_2021 | VFLEL | 5 | 6704 |
| PDH_2022 | AFLEL | 5 | 6705 |
| PDH_2023 | PFLES | 5 | 6706 |
| PDH_2024 | SFLEW | 5 | 6707 |
| PDH_2025 | AFLES | 5 | 6708 |
| PDH_2026 | AFLEW | 5 | 6709 |
| PDH_2027 | LFLEW | 5 | 6710 |
| PDH_2028 | PFLEL | 5 | 6711 |
| PDH_2029 | RFLEW | 5 | 4231 |
| PDH_2030 | RFLEL | 5 | 6712 |
| PDH_2031 | LFLES | 5 | 6713 |
| PDH_2032 | PFLEW | 5 | 6714 |
| PDH_2033 | SFLES | 5 | 6715 |
| PDH_2034 | IFLEW | 5 | 6716 |
| PDH_2035 | PGSYS | 5 | 6717 |
| PDH_2036 | AGSYA | 5 | 6718 |
| PDH_2037 | HGSYS | 5 | 6719 |
| PDH_2038 | HGSYY | 5 | 6720 |
| PDH_2039 | PGSYY | 5 | 6721 |
| PDH_2040 | SGSYS | 5 | 6722 |
| PDH_2041 | SGSYD | 5 | 6723 |
| PDH_2042 | SGSYA | 5 | 6724 |
| PDH_2043 | LGSYS | 5 | 6725 |
| PDH_2044 | VGSYS | 5 | 6726 |
| PDH_2045 | DGSYY | 5 | 6727 |
| PDH_2046 | FGSYS | 5 | 6728 |
| PDH_2047 | FGSYY | 5 | 6729 |
| PDH_2048 | HGSYD | 5 | 6730 |
| PDH_2049 | LGSYA | 5 | 6731 |
| PDH_2050 | HGSYA | 5 | 6732 |
| PDH_2051 | LGSYD | 5 | 6733 |
| PDH_2052 | DGSYS | 5 | 6734 |
| PDH_2053 | VGSYD | 5 | 6735 |
| PDH_2054 | VGSYY | 5 | 6736 |
| PDH_2055 | AGSYY | 5 | 6737 |
| PDH_2056 | YGSYS | 5 | 6738 |
| PDH_2057 | AGSYS | 5 | 6739 |
| PDH_2058 | AGSYD | 5 | 6740 |
| PDH_2059 | VGSYA | 5 | 6741 |
| PDH_2060 | DGSYD | 5 | 6742 |
| PDH_2061 | FGSYD | 5 | 6743 |
| PDH_2062 | DGSYA | 5 | 6744 |
| PDH_2063 | YGSYA | 5 | 6745 |
| PDH_2064 | FGSYA | 5 | 6746 |
| PDH_2065 | YGSYD | 5 | 6747 |
| PDH_2066 | LGSYY | 5 | 6748 |
| PDH_2067 | SGSYY | 5 | 3761 |
| PDH_2068 | PGSYA | 5 | 6749 |
| PDH_2069 | PGSYD | 5 | 6750 |
| PDH_2070 | YGSYY | 5 | 6751 |
| PDH_2071 | FSGSF | 5 | 6752 |
| PDH_2072 | FSGSY | 5 | 6753 |
| PDH_2073 | YSGSF | 5 | 6754 |
| PDH_2074 | YSGSS | 5 | 6755 |
| PDH_2075 | FSGSS | 5 | 6756 |
| PDH_2076 | YSGSY | 5 | 3760 |
| PDH_2077 | ASSSW | 5 | 6757 |
| PDH_2078 | VSSSS | 5 | 6758 |
| PDH_2079 | YSSSS | 5 | 4478 |
| PDH_2080 | YSSSL | 5 | 6759 |
| PDH_2081 | VSSSW | 5 | 6760 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2082 | ASSSL | 5 | 6761 |
| PDH_2083 | HSSSL | 5 | 6762 |
| PDH_2084 | PSSSL | 5 | 6763 |
| PDH_2085 | ASSSS | 5 | 6764 |
| PDH_2086 | HSSSW | 5 | 6765 |
| PDH_2087 | VSSSL | 5 | 6766 |
| PDH_2088 | FSSSL | 5 | 6767 |
| PDH_2089 | HSSSS | 5 | 6768 |
| PDH_2090 | FSSSW | 5 | 6769 |
| PDH_2091 | SSSSS | 5 | 6770 |
| PDH_2092 | DSSSS | 5 | 6771 |
| PDH_2093 | SSSSL | 5 | 6772 |
| PDH_2094 | FSSSS | 5 | 6773 |
| PDH_2095 | LSSSW | 5 | 6774 |
| PDH_2096 | DSSSL | 5 | 6775 |
| PDH_2097 | LSSSS | 5 | 6776 |
| PDH_2098 | LSSSL | 5 | 6777 |
| PDH_2099 | SSSSW | 5 | 6778 |
| PDH_2100 | DSSSW | 5 | 6779 |
| PDH_2101 | PSSSW | 5 | 6780 |
| PDH_2102 | PSSSS | 5 | 6781 |
| PDH_2103 | YSSSW | 5 | 4439 |
| PDH_2104 | HSSGW | 5 | 6782 |
| PDH_2105 | FSSGL | 5 | 6783 |
| PDH_2106 | SSSGW | 5 | 6784 |
| PDH_2107 | SSSGS | 5 | 6785 |
| PDH_2108 | DSSGL | 5 | 6786 |
| PDH_2109 | HSSGS | 5 | 6787 |
| PDH_2110 | FSSGW | 5 | 6788 |
| PDH_2111 | ASSGW | 5 | 6789 |
| PDH_2112 | DSSGW | 5 | 6790 |
| PDH_2113 | DSSGS | 5 | 6791 |
| PDH_2114 | ASSGL | 5 | 6792 |
| PDH_2115 | LSSGL | 5 | 6793 |
| PDH_2116 | FSSGS | 5 | 6794 |
| PDH_2117 | ASSGS | 5 | 6795 |
| PDH_2118 | PSSGS | 5 | 6796 |
| PDH_2119 | LSSGW | 5 | 6797 |
| PDH_2120 | LSSGS | 5 | 6798 |
| PDH_2121 | YSSGL | 5 | 6799 |
| PDH_2122 | VSSGS | 5 | 6800 |
| PDH_2123 | PSSGW | 5 | 6801 |
| PDH_2124 | PSSGL | 5 | 6802 |
| PDH_2125 | VSSGL | 5 | 6803 |
| PDH_2126 | VSSGW | 5 | 6804 |
| PDH_2127 | YSSGW | 5 | 4460 |
| PDH_2128 | SSSGL | 5 | 6805 |
| PDH_2129 | HSSGL | 5 | 6806 |
| PDH_2130 | YSSGS | 5 | 6807 |
| PDH_2131 | VTVTT | 5 | 6808 |
| PDH_2132 | RTVTT | 5 | 6809 |
| PDH_2133 | LTVTK | 5 | 6810 |
| PDH_2134 | ATVTK | 5 | 6811 |
| PDH_2135 | GTVTT | 5 | 6812 |
| PDH_2136 | VTVTK | 5 | 6813 |
| PDH_2137 | LTVTR | 5 | 6814 |
| PDH_2138 | ATVTT | 5 | 6815 |
| PDH_2139 | RTVTR | 5 | 6816 |
| PDH_2140 | VTVTR | 5 | 6817 |
| PDH_2141 | TTVTK | 5 | 6818 |
| PDH_2142 | GTVTR | 5 | 6819 |
| PDH_2143 | TTVTI | 5 | 6820 |
| PDH_2144 | RTVTK | 5 | 6821 |
| PDH_2145 | LTVTT | 5 | 6822 |
| PDH_2146 | VTVTI | 5 | 6823 |
| PDH_2147 | GTVTK | 5 | 6824 |
| PDH_2148 | TTVTR | 5 | 6825 |
| PDH_2149 | GTVTI | 5 | 6826 |
| PDH_2150 | PTVTI | 5 | 6827 |
| PDH_2151 | TTVTT | 5 | 4351 |
| PDH_2152 | STVTT | 5 | 6828 |
| PDH_2153 | STVTI | 5 | 6829 |
| PDH_2154 | ITVTI | 5 | 6830 |
| PDH_2155 | STVTK | 5 | 6831 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2156 | STVTR | 5 | 6832 |
| PDH_2157 | ATVTI | 5 | 6833 |
| PDH_2158 | ITVTT | 5 | 6834 |
| PDH_2159 | ITVTR | 5 | 6835 |
| PDH_2160 | LTVTI | 5 | 6836 |
| PDH_2161 | PTVTR | 5 | 6837 |
| PDH_2162 | ATVTR | 5 | 6838 |
| PDH_2163 | PTVTK | 5 | 6839 |
| PDH_2164 | RTVTI | 5 | 6840 |
| PDH_2165 | ITVTK | 5 | 6841 |
| PDH_2166 | PTVTT | 5 | 6842 |
| PDH_2167 | ASSSF | 5 | 6843 |
| PDH_2168 | ASSSY | 5 | 6844 |
| PDH_2169 | PSSSF | 5 | 6845 |
| PDH_2170 | HSSSF | 5 | 6846 |
| PDH_2171 | VSSSY | 5 | 6847 |
| PDH_2172 | YSSSF | 5 | 6848 |
| PDH_2173 | FSSSF | 5 | 6849 |
| PDH_2174 | HSSSY | 5 | 6850 |
| PDH_2175 | VSSSF | 5 | 6851 |
| PDH_2176 | SSSSY | 5 | 6852 |
| PDH_2177 | SSSSF | 5 | 6853 |
| PDH_2178 | LSSSY | 5 | 6854 |
| PDH_2179 | DSSSY | 5 | 6855 |
| PDH_2180 | FSSSY | 5 | 6856 |
| PDH_2181 | PSSSY | 5 | 6857 |
| PDH_2182 | YSSSY | 5 | 6858 |
| PDH_2183 | DSSSF | 5 | 6859 |
| PDH_2184 | LSSSF | 5 | 6860 |
| PDH_2185 | FSGWF | 5 | 6861 |
| PDH_2186 | FSGWS | 5 | 6862 |
| PDH_2187 | ISGWY | 5 | 6863 |
| PDH_2188 | FSGWY | 5 | 6864 |
| PDH_2189 | ISGWS | 5 | 6865 |
| PDH_2190 | PSGWS | 5 | 6866 |
| PDH_2191 | DSGWF | 5 | 6867 |
| PDH_2192 | PSGWY | 5 | 6868 |
| PDH_2193 | PSGWF | 5 | 6869 |
| PDH_2194 | TSGWY | 5 | 6870 |
| PDH_2195 | ASGWF | 5 | 6871 |
| PDH_2196 | LSGWF | 5 | 6872 |
| PDH_2197 | ISGWF | 5 | 6873 |
| PDH_2198 | SSGWY | 5 | 4461 |
| PDH_2199 | SSGWS | 5 | 6874 |
| PDH_2200 | SSGWF | 5 | 6875 |
| PDH_2201 | NSGWS | 5 | 6876 |
| PDH_2202 | NSGWY | 5 | 6877 |
| PDH_2203 | NSGWF | 5 | 6878 |
| PDH_2204 | VSGWS | 5 | 6879 |
| PDH_2205 | VSGWY | 5 | 6880 |
| PDH_2206 | YSGWF | 5 | 6881 |
| PDH_2207 | LSGWS | 5 | 6882 |
| PDH_2208 | ASGWY | 5 | 6883 |
| PDH_2209 | LSGWY | 5 | 6884 |
| PDH_2210 | TSGWF | 5 | 6885 |
| PDH_2211 | TSGWS | 5 | 6886 |
| PDH_2212 | DSGWY | 5 | 6887 |
| PDH_2213 | DSGWS | 5 | 6888 |
| PDH_2214 | ASGWS | 5 | 6889 |
| PDH_2215 | HSGWF | 5 | 6890 |
| PDH_2216 | HSGWS | 5 | 6891 |
| PDH_2217 | YSGWS | 5 | 6892 |
| PDH_2218 | HSGWY | 5 | 6893 |
| PDH_2219 | YSGWY | 5 | 6894 |
| PDH_2220 | VSGWF | 5 | 6895 |
| PDH_2221 | ISGYD | 5 | 6896 |
| PDH_2222 | HSGYA | 5 | 6897 |
| PDH_2223 | ISGYA | 5 | 6898 |
| PDH_2224 | HSGYG | 5 | 6899 |
| PDH_2225 | TSGYD | 5 | 6900 |
| PDH_2226 | TSGYA | 5 | 6901 |
| PDH_2227 | DSGYA | 5 | 6902 |
| PDH_2228 | LSGYA | 5 | 6903 |
| PDH_2229 | FSGYA | 5 | 6904 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2230 | LSGYD | 5 | 6905 |
| PDH_2231 | FSGYG | 5 | 6906 |
| PDH_2232 | SSGYD | 5 | 6907 |
| PDH_2233 | SSGYA | 5 | 6908 |
| PDH_2234 | ISGYG | 5 | 6909 |
| PDH_2235 | HSGYD | 5 | 6910 |
| PDH_2236 | ASGYD | 5 | 6911 |
| PDH_2237 | YSGYA | 5 | 6912 |
| PDH_2238 | YSGYD | 5 | 4389 |
| PDH_2239 | VSGYA | 5 | 6913 |
| PDH_2240 | VSGYG | 5 | 6914 |
| PDH_2241 | SSGYG | 5 | 6915 |
| PDH_2242 | DSGYD | 5 | 6916 |
| PDH_2243 | DSGYG | 5 | 6917 |
| PDH_2244 | FSGYD | 5 | 6918 |
| PDH_2245 | LSGYG | 5 | 6919 |
| PDH_2246 | TSGYG | 5 | 6920 |
| PDH_2247 | NSGYA | 5 | 6921 |
| PDH_2248 | NSGYG | 5 | 6922 |
| PDH_2249 | NSGYD | 5 | 6923 |
| PDH_2250 | PSGYA | 5 | 6924 |
| PDH_2251 | PSGYG | 5 | 6925 |
| PDH_2252 | PSGYD | 5 | 6926 |
| PDH_2253 | ASGYG | 5 | 6927 |
| PDH_2254 | VSGYD | 5 | 6928 |
| PDH_2255 | ASGYA | 5 | 6929 |
| PDH_2256 | YSGYG | 5 | 6930 |
| PDH_2257 | FYYDS | 5 | 6931 |
| PDH_2258 | YYYDT | 5 | 6932 |
| PDH_2259 | DYYDS | 5 | 6933 |
| PDH_2260 | AYYDS | 5 | 6934 |
| PDH_2261 | AYYDT | 5 | 6935 |
| PDH_2262 | DYYDI | 5 | 6936 |
| PDH_2263 | VYYDI | 5 | 6937 |
| PDH_2264 | FYYDT | 5 | 6938 |
| PDH_2265 | LYYDI | 5 | 6939 |
| PDH_2266 | PYYDI | 5 | 6940 |
| PDH_2267 | HYYDI | 5 | 6941 |
| PDH_2268 | IYYDI | 5 | 6942 |
| PDH_2269 | LYYDS | 5 | 6943 |
| PDH_2270 | SYYDI | 5 | 6944 |
| PDH_2271 | NYYDT | 5 | 6945 |
| PDH_2272 | NYYDS | 5 | 6946 |
| PDH_2273 | SYYDT | 5 | 6947 |
| PDH_2274 | AYYDI | 5 | 6948 |
| PDH_2275 | SYYDS | 5 | 6949 |
| PDH_2276 | DYYDT | 5 | 6950 |
| PDH_2277 | VYYDT | 5 | 6951 |
| PDH_2278 | YYYDI | 5 | 6952 |
| PDH_2279 | VYYDS | 5 | 6953 |
| PDH_2280 | FYYDI | 5 | 6954 |
| PDH_2281 | YYYDS | 5 | 4176 |
| PDH_2282 | TYYDT | 5 | 6955 |
| PDH_2283 | NYYDI | 5 | 6956 |
| PDH_2284 | HYYDS | 5 | 6957 |
| PDH_2285 | LYYDT | 5 | 6958 |
| PDH_2286 | IYYDT | 5 | 6959 |
| PDH_2287 | IYYDS | 5 | 6960 |
| PDH_2288 | PYYDT | 5 | 6961 |
| PDH_2289 | PYYDS | 5 | 6962 |
| PDH_2290 | TYYDI | 5 | 6963 |
| PDH_2291 | HYYDT | 5 | 6964 |
| PDH_2292 | TYYDS | 5 | 6965 |
| PDH_2293 | DSSGY | 5 | 4179 |
| PDH_2294 | SSSGY | 5 | 6966 |
| PDH_2295 | DSSGF | 5 | 6967 |
| PDH_2296 | HSSGY | 5 | 6968 |
| PDH_2297 | SSSGF | 5 | 6969 |
| PDH_2298 | ASSGF | 5 | 6970 |
| PDH_2299 | ASSGY | 5 | 6971 |
| PDH_2300 | LSSGF | 5 | 6972 |
| PDH_2301 | FSSGY | 5 | 6973 |
| PDH_2302 | FSSGF | 5 | 6974 |
| PDH_2303 | YSSGF | 5 | 6975 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2304 | PSSGY | 5 | 6976 |
| PDH_2305 | VSSGY | 5 | 6977 |
| PDH_2306 | LSSGY | 5 | 6978 |
| PDH_2307 | HSSGF | 5 | 6979 |
| PDH_2308 | PSSGF | 5 | 6980 |
| PDH_2309 | VSSGF | 5 | 6981 |
| PDH_2310 | YSSGY | 5 | 6982 |
| PDH_2311 | QAARH | 5 | 6983 |
| PDH_2312 | QAARP | 5 | 6984 |
| PDH_2313 | TAARR | 5 | 6985 |
| PDH_2314 | QAARL | 5 | 6986 |
| PDH_2315 | KAARR | 5 | 6987 |
| PDH_2316 | KAARP | 5 | 6988 |
| PDH_2317 | KAARH | 5 | 6989 |
| PDH_2318 | TAARH | 5 | 6990 |
| PDH_2319 | TAARP | 5 | 6991 |
| PDH_2320 | EAARL | 5 | 6992 |
| PDH_2321 | EAARP | 5 | 6993 |
| PDH_2322 | AAARL | 5 | 6994 |
| PDH_2323 | LAARL | 5 | 6995 |
| PDH_2324 | IAARL | 5 | 6996 |
| PDH_2325 | IAARH | 5 | 6997 |
| PDH_2326 | LAARR | 5 | 6998 |
| PDH_2327 | LAARH | 5 | 6999 |
| PDH_2328 | EAARH | 5 | 7000 |
| PDH_2329 | IAARR | 5 | 7001 |
| PDH_2330 | QAARR | 5 | 7002 |
| PDH_2331 | IAARP | 5 | 4483 |
| PDH_2332 | EAARR | 5 | 7003 |
| PDH_2333 | KAARL | 5 | 7004 |
| PDH_2334 | PAARR | 5 | 7005 |
| PDH_2335 | PAARP | 5 | 7006 |
| PDH_2336 | PAARH | 5 | 7007 |
| PDH_2337 | PAARL | 5 | 7008 |
| PDH_2338 | VAARR | 5 | 7009 |
| PDH_2339 | AAARH | 5 | 7010 |
| PDH_2340 | VAARP | 5 | 7011 |
| PDH_2341 | VAARH | 5 | 7012 |
| PDH_2342 | AAARP | 5 | 7013 |
| PDH_2343 | AAARR | 5 | 7014 |
| PDH_2344 | TAARL | 5 | 7015 |
| PDH_2345 | LAARP | 5 | 7016 |
| PDH_2346 | VAARL | 5 | 7017 |
| PDH_2347 | EYYYG | 5 | 7018 |
| PDH_2348 | VYYYD | 5 | 7019 |
| PDH_2349 | EYYYA | 5 | 7020 |
| PDH_2350 | VYYYG | 5 | 7021 |
| PDH_2351 | EYYYD | 5 | 7022 |
| PDH_2352 | PYYYD | 5 | 7023 |
| PDH_2353 | PYYYG | 5 | 7024 |
| PDH_2354 | AYYYG | 5 | 7025 |
| PDH_2355 | TYYYA | 5 | 7026 |
| PDH_2356 | TYYYG | 5 | 7027 |
| PDH_2357 | TYYYD | 5 | 7028 |
| PDH_2358 | QYYYA | 5 | 7029 |
| PDH_2359 | QYYYG | 5 | 7030 |
| PDH_2360 | QYYYD | 5 | 7031 |
| PDH_2361 | VYYYA | 5 | 7032 |
| PDH_2362 | LYYYG | 5 | 7033 |
| PDH_2363 | LYYYD | 5 | 7034 |
| PDH_2364 | LYYYA | 5 | 7035 |
| PDH_2365 | AYYYD | 5 | 7036 |
| PDH_2366 | AYYYA | 5 | 7037 |
| PDH_2367 | PYYYA | 5 | 7038 |
| PDH_2368 | MYYYD | 5 | 7039 |
| PDH_2369 | KYYYD | 5 | 7040 |
| PDH_2370 | KYYYG | 5 | 7041 |
| PDH_2371 | MYYYA | 5 | 7042 |
| PDH_2372 | KYYYA | 5 | 7043 |
| PDH_2373 | MYYYG | 5 | 7044 |
| PDH_2374 | LTMVR | 5 | 7045 |
| PDH_2375 | RTMVQ | 5 | 7046 |
| PDH_2376 | VTMVQ | 5 | 7047 |
| PDH_2377 | TTMVR | 5 | 7048 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2378 | LTMVQ | 5 | 7049 |
| PDH_2379 | STMVQ | 5 | 7050 |
| PDH_2380 | ATMVQ | 5 | 7051 |
| PDH_2381 | PTMVR | 5 | 7052 |
| PDH_2382 | RTMVR | 5 | 7053 |
| PDH_2383 | ITMVQ | 5 | 4055 |
| PDH_2384 | GTMVR | 5 | 7054 |
| PDH_2385 | VTMVR | 5 | 7055 |
| PDH_2386 | PTMVQ | 5 | 7056 |
| PDH_2387 | ITMVR | 5 | 4009 |
| PDH_2388 | ATMVR | 5 | 7057 |
| PDH_2389 | STMVR | 5 | 7058 |
| PDH_2390 | TTMVQ | 5 | 7059 |
| PDH_2391 | GTMVQ | 5 | 7060 |
| PDH_2392 | HMVQG | 5 | 7061 |
| PDH_2393 | DMVQG | 5 | 7062 |
| PDH_2394 | LMVQG | 5 | 7063 |
| PDH_2395 | SMVQG | 5 | 7064 |
| PDH_2396 | FMVQG | 5 | 7065 |
| PDH_2397 | NMVQG | 5 | 7066 |
| PDH_2398 | VMVQG | 5 | 7067 |
| PDH_2399 | TMVQG | 5 | 4056 |
| PDH_2400 | PMVQG | 5 | 7068 |
| PDH_2401 | YMVQG | 5 | 7069 |
| PDH_2402 | AMVQG | 5 | 7070 |
| PDH_2403 | IMVQG | 5 | 7071 |
| PDH_2404 | PWGSY | 5 | 7072 |
| PDH_2405 | TWGSY | 5 | 7073 |
| PDH_2406 | SWGSY | 5 | 7074 |
| PDH_2407 | HWGSY | 5 | 7075 |
| PDH_2408 | LWGSY | 5 | 7076 |
| PDH_2409 | DWGSY | 5 | 7077 |
| PDH_2410 | FWGSY | 5 | 7078 |
| PDH_2411 | AWGSY | 5 | 7079 |
| PDH_2412 | YWGSY | 5 | 7080 |
| PDH_2413 | IWGSY | 5 | 7081 |
| PDH_2414 | NWGSY | 5 | 7082 |
| PDH_2415 | VWGSY | 5 | 4102 |
| PDH_2416 | FSSSWF | 6 | 7083 |
| PDH_2417 | HSSSWS | 6 | 7084 |
| PDH_2418 | VSSSWF | 6 | 7085 |
| PDH_2419 | HSSSWY | 6 | 7086 |
| PDH_2420 | VSSSWS | 6 | 7087 |
| PDH_2421 | LSSSWY | 6 | 7088 |
| PDH_2422 | VSSSWY | 6 | 7089 |
| PDH_2423 | HSSSWF | 6 | 7090 |
| PDH_2424 | ASSSWY | 6 | 7091 |
| PDH_2425 | DSSSWS | 6 | 7092 |
| PDH_2426 | PSSSWY | 6 | 7093 |
| PDH_2427 | ASSSWS | 6 | 7094 |
| PDH_2428 | DSSSWF | 6 | 7095 |
| PDH_2429 | DSSSWY | 6 | 7096 |
| PDH_2430 | YSSSWS | 6 | 7097 |
| PDH_2431 | YSSSWF | 6 | 7098 |
| PDH_2432 | ASSSWF | 6 | 7099 |
| PDH_2433 | LSSSWS | 6 | 7100 |
| PDH_2434 | SSSSWS | 6 | 7101 |
| PDH_2435 | YSSSWY | 6 | 4437 |
| PDH_2436 | PSSSWS | 6 | 7102 |
| PDH_2437 | SSSSWY | 6 | 7103 |
| PDH_2438 | LSSSWF | 6 | 7104 |
| PDH_2439 | PSSSWF | 6 | 7105 |
| PDH_2440 | FSSSWS | 6 | 7106 |
| PDH_2441 | SSSSWF | 6 | 7107 |
| PDH_2442 | FSSSWY | 6 | 7108 |
| PDH_2443 | AYYDST | 6 | 7109 |
| PDH_2444 | AYYDSI | 6 | 7110 |
| PDH_2445 | YYYDST | 6 | 7111 |
| PDH_2446 | PYYDST | 6 | 7112 |
| PDH_2447 | VYYDSS | 6 | 7113 |
| PDH_2448 | NYYDSI | 6 | 7114 |
| PDH_2449 | PYYDSS | 6 | 7115 |
| PDH_2450 | YYYDSS | 6 | 4171 |
| PDH_2451 | YYYDSI | 6 | 7116 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2452 | VYYDST | 6 | 7117 |
| PDH_2453 | VYYDSI | 6 | 7118 |
| PDH_2454 | NYYDST | 6 | 7119 |
| PDH_2455 | LYYDST | 6 | 7120 |
| PDH_2456 | NYYDSS | 6 | 7121 |
| PDH_2457 | SYYDSI | 6 | 7122 |
| PDH_2458 | LYYDSS | 6 | 7123 |
| PDH_2459 | SYYDST | 6 | 7124 |
| PDH_2460 | LYYDSI | 6 | 7125 |
| PDH_2461 | SYYDSS | 6 | 7126 |
| PDH_2462 | DYYDSI | 6 | 7127 |
| PDH_2463 | DYYDST | 6 | 7128 |
| PDH_2464 | DYYDSS | 6 | 7129 |
| PDH_2465 | FYYDSS | 6 | 7130 |
| PDH_2466 | TYYDSI | 6 | 7131 |
| PDH_2467 | FYYDST | 6 | 7132 |
| PDH_2468 | IYYDST | 6 | 7133 |
| PDH_2469 | FYYDSI | 6 | 7134 |
| PDH_2470 | IYYDSS | 6 | 7135 |
| PDH_2471 | TYYDSS | 6 | 7136 |
| PDH_2472 | TYYDST | 6 | 7137 |
| PDH_2473 | HYYDSS | 6 | 7138 |
| PDH_2474 | HYYDST | 6 | 7139 |
| PDH_2475 | IYYDSI | 6 | 7140 |
| PDH_2476 | HYYDSI | 6 | 7141 |
| PDH_2477 | PYYDSI | 6 | 7142 |
| PDH_2478 | AYYDSS | 6 | 7143 |
| PDH_2479 | LYSGYA | 6 | 7144 |
| PDH_2480 | GYSGYV | 6 | 7145 |
| PDH_2481 | SYSGYD | 6 | 7146 |
| PDH_2482 | LYSGYD | 6 | 7147 |
| PDH_2483 | IYSGYV | 6 | 7148 |
| PDH_2484 | SYSGYG | 6 | 7149 |
| PDH_2485 | IYSGYG | 6 | 7150 |
| PDH_2486 | SYSGYA | 6 | 7151 |
| PDH_2487 | PYSGYG | 6 | 7152 |
| PDH_2488 | VYSGYD | 6 | 7153 |
| PDH_2489 | PYSGYA | 6 | 7154 |
| PDH_2490 | VYSGYV | 6 | 7155 |
| PDH_2491 | GYSGYG | 6 | 7156 |
| PDH_2492 | VYSGYA | 6 | 7157 |
| PDH_2493 | PYSGYV | 6 | 7158 |
| PDH_2494 | GYSGYA | 6 | 7159 |
| PDH_2495 | IYSGYD | 6 | 7160 |
| PDH_2496 | PYSGYD | 6 | 7161 |
| PDH_2497 | RYSGYV | 6 | 7162 |
| PDH_2498 | RYSGYA | 6 | 7163 |
| PDH_2499 | RYSGYG | 6 | 7164 |
| PDH_2500 | GYSGYD | 6 | 4386 |
| PDH_2501 | IYSGYA | 6 | 7165 |
| PDH_2502 | AYSGYA | 6 | 7166 |
| PDH_2503 | RYSGYD | 6 | 7167 |
| PDH_2504 | AYSGYG | 6 | 7168 |
| PDH_2505 | AYSGYD | 6 | 7169 |
| PDH_2506 | AYSGYV | 6 | 7170 |
| PDH_2507 | VYSGYG | 6 | 7171 |
| PDH_2508 | TYSGYV | 6 | 7172 |
| PDH_2509 | TYSGYD | 6 | 7173 |
| PDH_2510 | TYSGYA | 6 | 7174 |
| PDH_2511 | TYSGYG | 6 | 7175 |
| PDH_2512 | SYSGYV | 6 | 7176 |
| PDH_2513 | LYSGYV | 6 | 7177 |
| PDH_2514 | LYSGYG | 6 | 7178 |
| PDH_2515 | SSSGWF | 6 | 7179 |
| PDH_2516 | PSSGWY | 6 | 7180 |
| PDH_2517 | FSSGWF | 6 | 7181 |
| PDH_2518 | PSSGWS | 6 | 7182 |
| PDH_2519 | FSSGWS | 6 | 7183 |
| PDH_2520 | ASSGWY | 6 | 7184 |
| PDH_2521 | FSSGWY | 6 | 7185 |
| PDH_2522 | ASSGWS | 6 | 7186 |
| PDH_2523 | SSSGWS | 6 | 7187 |
| PDH_2524 | YSSGWY | 6 | 4458 |
| PDH_2525 | SSSGWY | 6 | 7188 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2526 | HSSGWS | 6 | 7189 |
| PDH_2527 | DSSGWS | 6 | 7190 |
| PDH_2528 | YSSGWS | 6 | 7191 |
| PDH_2529 | LSSGWF | 6 | 7192 |
| PDH_2530 | HSSGWY | 6 | 7193 |
| PDH_2531 | DSSGWF | 6 | 7194 |
| PDH_2532 | DSSGWY | 6 | 7195 |
| PDH_2533 | LSSGWY | 6 | 7196 |
| PDH_2534 | HSSGWF | 6 | 7197 |
| PDH_2535 | VSSGWS | 6 | 7198 |
| PDH_2536 | LSSGWS | 6 | 7199 |
| PDH_2537 | VSSGWY | 6 | 7200 |
| PDH_2538 | VSSGWF | 6 | 7201 |
| PDH_2539 | PSSGWF | 6 | 7202 |
| PDH_2540 | ASSGWF | 6 | 7203 |
| PDH_2541 | YSSGWF | 6 | 7204 |
| PDH_2542 | IYYGSA | 6 | 7205 |
| PDH_2543 | PYYGSG | 6 | 7206 |
| PDH_2544 | PYYGSA | 6 | 7207 |
| PDH_2545 | PYYGSD | 6 | 7208 |
| PDH_2546 | VYYGSD | 6 | 7209 |
| PDH_2547 | AYYGSA | 6 | 7210 |
| PDH_2548 | VYYGSA | 6 | 7211 |
| PDH_2549 | NYYGSA | 6 | 7212 |
| PDH_2550 | YYYGSA | 6 | 7213 |
| PDH_2551 | AYYGSD | 6 | 7214 |
| PDH_2552 | NYYGSD | 6 | 7215 |
| PDH_2553 | YYYGSD | 6 | 7216 |
| PDH_2554 | FYYGSD | 6 | 7217 |
| PDH_2555 | NYYGSG | 6 | 7218 |
| PDH_2556 | YYYGSG | 6 | 3979 |
| PDH_2557 | FYYGSA | 6 | 7219 |
| PDH_2558 | FYYGSG | 6 | 7220 |
| PDH_2559 | AYYGSG | 6 | 7221 |
| PDH_2560 | LYYGSG | 6 | 7222 |
| PDH_2561 | DYYGSD | 6 | 7223 |
| PDH_2562 | LYYGSA | 6 | 7224 |
| PDH_2563 | TYYGSD | 6 | 7225 |
| PDH_2564 | DYYGSG | 6 | 7226 |
| PDH_2565 | DYYGSA | 6 | 7227 |
| PDH_2566 | LYYGSD | 6 | 7228 |
| PDH_2567 | HYYGSD | 6 | 7229 |
| PDH_2568 | TYYGSA | 6 | 7230 |
| PDH_2569 | TYYGSG | 6 | 7231 |
| PDH_2570 | HYYGSA | 6 | 7232 |
| PDH_2571 | SYYGSG | 6 | 7233 |
| PDH_2572 | HYYGSG | 6 | 7234 |
| PDH_2573 | SYYGSD | 6 | 7235 |
| PDH_2574 | VYYGSG | 6 | 7236 |
| PDH_2575 | SYYGSA | 6 | 7237 |
| PDH_2576 | IYYGSG | 6 | 7238 |
| PDH_2577 | IYYGSD | 6 | 7239 |
| PDH_2578 | VSSGYS | 6 | 7240 |
| PDH_2579 | VSSGYY | 6 | 7241 |
| PDH_2580 | FSSGYY | 6 | 7242 |
| PDH_2581 | ASSGYF | 6 | 7243 |
| PDH_2582 | ASSGYS | 6 | 7244 |
| PDH_2583 | FSSGYS | 6 | 7245 |
| PDH_2584 | SSSGYY | 6 | 7246 |
| PDH_2585 | ASSGYY | 6 | 7247 |
| PDH_2586 | FSSGYF | 6 | 7248 |
| PDH_2587 | HSSGYY | 6 | 7249 |
| PDH_2588 | DSSGYY | 6 | 4174 |
| PDH_2589 | HSSGYS | 6 | 7250 |
| PDH_2590 | SSSGYS | 6 | 7251 |
| PDH_2591 | DSSGYS | 6 | 7252 |
| PDH_2592 | DSSGYF | 6 | 7253 |
| PDH_2593 | HSSGYF | 6 | 7254 |
| PDH_2594 | PSSGYF | 6 | 7255 |
| PDH_2595 | SSSGYF | 6 | 7256 |
| PDH_2596 | YSSGYY | 6 | 7257 |
| PDH_2597 | YSSGYF | 6 | 7258 |
| PDH_2598 | YSSGYS | 6 | 7259 |
| PDH_2599 | PSSGYS | 6 | 7260 |

TABLE 28-continued

Theoretical segment pool of unique DH polypeptide segments encoded by the degenerate oligonucleotides of Table 27.

| Name | Sequence | Length | SEQ ID NO |
| --- | --- | --- | --- |
| PDH_2600 | PSSGYY | 6 | 7261 |
| PDH_2601 | LSSGYY | 6 | 7262 |
| PDH_2602 | LSSGYF | 6 | 7263 |
| PDH_2603 | LSSGYS | 6 | 7264 |
| PDH_2604 | VSSGYF | 6 | 7265 |
| PDH_2605 | TYDSSD | 6 | 7266 |
| PDH_2606 | YYDSSA | 6 | 7267 |
| PDH_2607 | YYDSSG | 6 | 4172 |
| PDH_2608 | LYDSSD | 6 | 7268 |
| PDH_2609 | LYDSSA | 6 | 7269 |
| PDH_2610 | PYDSSA | 6 | 7270 |
| PDH_2611 | LYDSSG | 6 | 7271 |
| PDH_2612 | PYDSSD | 6 | 7272 |
| PDH_2613 | VYDSSD | 6 | 7273 |
| PDH_2614 | HYDSSG | 6 | 7274 |
| PDH_2615 | VYDSSG | 6 | 7275 |
| PDH_2616 | VYDSSA | 6 | 7276 |
| PDH_2617 | PYDSSG | 6 | 7277 |
| PDH_2618 | SYDSSA | 6 | 7278 |
| PDH_2619 | FYDSSG | 6 | 7279 |
| PDH_2620 | NYDSSA | 6 | 7280 |
| PDH_2621 | SYDSSG | 6 | 7281 |
| PDH_2622 | FYDSSA | 6 | 7282 |
| PDH_2623 | NYDSSD | 6 | 7283 |
| PDH_2624 | SYDSSD | 6 | 7284 |
| PDH_2625 | FYDSSD | 6 | 7285 |
| PDH_2626 | DYDSSG | 6 | 7286 |
| PDH_2627 | AYDSSG | 6 | 7287 |
| PDH_2628 | NYDSSG | 6 | 7288 |
| PDH_2629 | IYDSSA | 6 | 7289 |
| PDH_2630 | DYDSSD | 6 | 7290 |
| PDH_2631 | IYDSSG | 6 | 7291 |
| PDH_2632 | AYDSSD | 6 | 7292 |
| PDH_2633 | DYDSSA | 6 | 7293 |
| PDH_2634 | IYDSSD | 6 | 7294 |
| PDH_2635 | HYDSSA | 6 | 7295 |
| PDH_2636 | AYDSSA | 6 | 7296 |
| PDH_2637 | HYDSSD | 6 | 7297 |
| PDH_2638 | TYDSSG | 6 | 7298 |
| PDH_2639 | TYDSSA | 6 | 7299 |
| PDH_2640 | YYDSSD | 6 | 7300 |
| PDH_2641 | TDFWSA | 6 | 7301 |
| PDH_2642 | ADFWSG | 6 | 7302 |
| PDH_2643 | PDFWSG | 6 | 7303 |
| PDH_2644 | VDFWSD | 6 | 7304 |
| PDH_2645 | TDFWSD | 6 | 7305 |
| PDH_2646 | HDFWSA | 6 | 7306 |
| PDH_2647 | HDFWSD | 6 | 7307 |
| PDH_2648 | TDFWSG | 6 | 7308 |
| PDH_2649 | LDFWSA | 6 | 7309 |
| PDH_2650 | LDFWSG | 6 | 7310 |
| PDH_2651 | HDFWSG | 6 | 7311 |
| PDH_2652 | LDFWSD | 6 | 7312 |
| PDH_2653 | FDFWSG | 6 | 7313 |
| PDH_2654 | DDFWSD | 6 | 7314 |
| PDH_2655 | VDFWSA | 6 | 7315 |
| PDH_2656 | SDFWSD | 6 | 7316 |
| PDH_2657 | SDFWSG | 6 | 7317 |
| PDH_2658 | NDFWSD | 6 | 7318 |
| PDH_2659 | SDFWSA | 6 | 7319 |
| PDH_2660 | NDFWSA | 6 | 7320 |
| PDH_2661 | NDFWSG | 6 | 7321 |
| PDH_2662 | VDFWSG | 6 | 7322 |
| PDH_2663 | IDFWSD | 6 | 7323 |
| PDH_2664 | IDFWSG | 6 | 7324 |
| PDH_2665 | FDFWSA | 6 | 7325 |
| PDH_2666 | ADFWSD | 6 | 7326 |
| PDH_2667 | IDFWSA | 6 | 7327 |
| PDH_2668 | FDFWSD | 6 | 7328 |
| PDH_2669 | DDFWSG | 6 | 7329 |
| PDH_2670 | ADFWSA | 6 | 7330 |
| PDH_2671 | YDFWSA | 6 | 7331 |
| PDH_2672 | PDFWSD | 6 | 7332 |
| PDH_2673 | YDFWSG | 6 | 4253 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2674 | DDFWSA | 6 | 7333 |
| PDH_2675 | PDFWSA | 6 | 7334 |
| PDH_2676 | YDFWSD | 6 | 7335 |
| PDH_2677 | DDSSGY | 6 | 7336 |
| PDH_2678 | LDSSGY | 6 | 7337 |
| PDH_2679 | HDSSGS | 6 | 7338 |
| PDH_2680 | DDSSGF | 6 | 7339 |
| PDH_2681 | DDSSGS | 6 | 7340 |
| PDH_2682 | LDSSGS | 6 | 7341 |
| PDH_2683 | HDSSGY | 6 | 7342 |
| PDH_2684 | SDSSGS | 6 | 7343 |
| PDH_2685 | SDSSGF | 6 | 7344 |
| PDH_2686 | PDSSGS | 6 | 7345 |
| PDH_2687 | SDSSGY | 6 | 7346 |
| PDH_2688 | PDSSGY | 6 | 7347 |
| PDH_2689 | ADSSGY | 6 | 7348 |
| PDH_2690 | ADSSGS | 6 | 7349 |
| PDH_2691 | ADSSGF | 6 | 7350 |
| PDH_2692 | YDSSGF | 6 | 7351 |
| PDH_2693 | VDSSGF | 6 | 7352 |
| PDH_2694 | FDSSGF | 6 | 7353 |
| PDH_2695 | VDSSGY | 6 | 7354 |
| PDH_2696 | YDSSGY | 6 | 4173 |
| PDH_2697 | FDSSGS | 6 | 7355 |
| PDH_2698 | VDSSGS | 6 | 7356 |
| PDH_2699 | YDSSGS | 6 | 7357 |
| PDH_2700 | FDSSGY | 6 | 7358 |
| PDH_2701 | LDSSGF | 6 | 7359 |
| PDH_2702 | HDSSGF | 6 | 7360 |
| PDH_2703 | PDSSGF | 6 | 7361 |
| PDH_2704 | EYFDWS | 6 | 7362 |
| PDH_2705 | QYFDWL | 6 | 7363 |
| PDH_2706 | RYFDWF | 6 | 7364 |
| PDH_2707 | AYFDWF | 6 | 7365 |
| PDH_2708 | PYFDWF | 6 | 7366 |
| PDH_2709 | PYFDWP | 6 | 7367 |
| PDH_2710 | LYFDWP | 6 | 7368 |
| PDH_2711 | EYFDWP | 6 | 7369 |
| PDH_2712 | EYFDWL | 6 | 7370 |
| PDH_2713 | RYFDWL | 6 | 4305 |
| PDH_2714 | LYFDWL | 6 | 7371 |
| PDH_2715 | PYFDWL | 6 | 7372 |
| PDH_2716 | LYFDWS | 6 | 7373 |
| PDH_2717 | QYFDWS | 6 | 7374 |
| PDH_2718 | QYFDWF | 6 | 7375 |
| PDH_2719 | VYFDWF | 6 | 7376 |
| PDH_2720 | RYFDWP | 6 | 7377 |
| PDH_2721 | AYFDWP | 6 | 7378 |
| PDH_2722 | LYFDWF | 6 | 7379 |
| PDH_2723 | AYFDWL | 6 | 7380 |
| PDH_2724 | GYFDWF | 6 | 7381 |
| PDH_2725 | GYFDWS | 6 | 7382 |
| PDH_2726 | VYFDWL | 6 | 7383 |
| PDH_2727 | VYFDWS | 6 | 7384 |
| PDH_2728 | VYFDWP | 6 | 7385 |
| PDH_2729 | RYFDWS | 6 | 7386 |
| PDH_2730 | PYFDWS | 6 | 7387 |
| PDH_2731 | QYFDWP | 6 | 7388 |
| PDH_2732 | EYFDWF | 6 | 7389 |
| PDH_2733 | AYFDWS | 6 | 7390 |
| PDH_2734 | GYFDWL | 6 | 7391 |
| PDH_2735 | GYFDWP | 6 | 7392 |
| PDH_2736 | CGSTSC | 6 | 7393 |
| PDH_2737 | CSGTSC | 6 | 7394 |
| PDH_2738 | CSSTSC | 6 | 3814 |
| PDH_2739 | CGGTSC | 6 | 7395 |
| PDH_2740 | PYYGSE | 6 | 7396 |
| PDH_2741 | VYYGSE | 6 | 7397 |
| PDH_2742 | AYYGSE | 6 | 7398 |
| PDH_2743 | NYYGSE | 6 | 7399 |
| PDH_2744 | FYYGSE | 6 | 7400 |
| PDH_2745 | YYYGSE | 6 | 7401 |
| PDH_2746 | DYYGSE | 6 | 7402 |
| PDH_2747 | TYYGSE | 6 | 7403 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2748 | HYYGSE | 6 | 7404 |
| PDH_2749 | LYYGSE | 6 | 7405 |
| PDH_2750 | IYYGSE | 6 | 7406 |
| PDH_2751 | SYYGSE | 6 | 7407 |
| PDH_2752 | CSSGSC | 6 | 7408 |
| PDH_2753 | CGGGSC | 6 | 7409 |
| PDH_2754 | CGSGSC | 6 | 7410 |
| PDH_2755 | CSGGSC | 6 | 3775 |
| PDH_2756 | PFWSGS | 6 | 7411 |
| PDH_2757 | DFWSGF | 6 | 7412 |
| PDH_2758 | PFWSGY | 6 | 7413 |
| PDH_2759 | AFWSGY | 6 | 7414 |
| PDH_2760 | AFWSGS | 6 | 7415 |
| PDH_2761 | AFWSGF | 6 | 7416 |
| PDH_2762 | PFWSGF | 6 | 7417 |
| PDH_2763 | VFWSGY | 6 | 7418 |
| PDH_2764 | YFWSGF | 6 | 7419 |
| PDH_2765 | IFWSGS | 6 | 7420 |
| PDH_2766 | VFWSGF | 6 | 7421 |
| PDH_2767 | VFWSGS | 6 | 7422 |
| PDH_2768 | IFWSGF | 6 | 7423 |
| PDH_2769 | IFWSGY | 6 | 7424 |
| PDH_2770 | SFWSGF | 6 | 7425 |
| PDH_2771 | YFWSGY | 6 | 7426 |
| PDH_2772 | FFWSGS | 6 | 7427 |
| PDH_2773 | YFWSGS | 6 | 7428 |
| PDH_2774 | FFWSGY | 6 | 7429 |
| PDH_2775 | LFWSGF | 6 | 7430 |
| PDH_2776 | TFWSGF | 6 | 7431 |
| PDH_2777 | NFWSGF | 6 | 7432 |
| PDH_2778 | HFWSGF | 6 | 7433 |
| PDH_2779 | NFWSGS | 6 | 7434 |
| PDH_2780 | SFWSGS | 6 | 7435 |
| PDH_2781 | TFWSGS | 6 | 7436 |
| PDH_2782 | NFWSGY | 6 | 7437 |
| PDH_2783 | DFWSGY | 6 | 4254 |
| PDH_2784 | LFWSGY | 6 | 7438 |
| PDH_2785 | HFWSGS | 6 | 7439 |
| PDH_2786 | SFWSGY | 6 | 7440 |
| PDH_2787 | TFWSGY | 6 | 7441 |
| PDH_2788 | DFWSGS | 6 | 7442 |
| PDH_2789 | LFWSGS | 6 | 7443 |
| PDH_2790 | HFWSGY | 6 | 7444 |
| PDH_2791 | FFWSGF | 6 | 7445 |
| PDH_2792 | DYYDSSG | 7 | 7446 |
| PDH_2793 | SYYDSSG | 7 | 7447 |
| PDH_2794 | IYYDSSG | 7 | 7448 |
| PDH_2795 | HYYDSSG | 7 | 7449 |
| PDH_2796 | SYYDSSA | 7 | 7450 |
| PDH_2797 | SYYDSSD | 7 | 7451 |
| PDH_2798 | IYYDSSA | 7 | 7452 |
| PDH_2799 | AYYDSSA | 7 | 7453 |
| PDH_2800 | IYYDSSD | 7 | 7454 |
| PDH_2801 | AYYDSSD | 7 | 7455 |
| PDH_2802 | HYYDSSD | 7 | 7456 |
| PDH_2803 | VYYDSSD | 7 | 7457 |
| PDH_2804 | HYYDSSA | 7 | 7458 |
| PDH_2805 | AYYDSSG | 7 | 7459 |
| PDH_2806 | VYYDSSA | 7 | 7460 |
| PDH_2807 | LYYDSSG | 7 | 7461 |
| PDH_2808 | VYYDSSG | 7 | 7462 |
| PDH_2809 | LYYDSSD | 7 | 7463 |
| PDH_2810 | FYYDSSG | 7 | 7464 |
| PDH_2811 | LYYDSSA | 7 | 7465 |
| PDH_2812 | FYYDSSD | 7 | 7466 |
| PDH_2813 | TYYDSSG | 7 | 7467 |
| PDH_2814 | PYYDSSG | 7 | 7468 |
| PDH_2815 | FYYDSSA | 7 | 7469 |
| PDH_2816 | TYYDSSD | 7 | 7470 |
| PDH_2817 | NYYDSSG | 7 | 7471 |
| PDH_2818 | TYYDSSA | 7 | 7472 |
| PDH_2819 | PYYDSSA | 7 | 7473 |
| PDH_2820 | YYYDSSG | 7 | 4167 |
| PDH_2821 | PYYDSSD | 7 | 7474 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2822 | NYYDSSA | 7 | 7475 |
| PDH_2823 | YYYDSSD | 7 | 7476 |
| PDH_2824 | NYYDSSD | 7 | 7477 |
| PDH_2825 | YYYDSSA | 7 | 7478 |
| PDH_2826 | DYYDSSD | 7 | 7479 |
| PDH_2827 | DYYDSSA | 7 | 7480 |
| PDH_2828 | FDILTGF | 7 | 7481 |
| PDH_2829 | FDILTGS | 7 | 7482 |
| PDH_2830 | LDILTGY | 7 | 7483 |
| PDH_2831 | YDILTGF | 7 | 7484 |
| PDH_2832 | LDILTGS | 7 | 7485 |
| PDH_2833 | SDILTGF | 7 | 7486 |
| PDH_2834 | IDILTGS | 7 | 7487 |
| PDH_2835 | PDILTGS | 7 | 7488 |
| PDH_2836 | PDILTGF | 7 | 7489 |
| PDH_2837 | IDILTGF | 7 | 7490 |
| PDH_2838 | IDILTGY | 7 | 7491 |
| PDH_2839 | PDILTGY | 7 | 7492 |
| PDH_2840 | YDILTGY | 7 | 4325 |
| PDH_2841 | DDILTGF | 7 | 7493 |
| PDH_2842 | YDILTGS | 7 | 7494 |
| PDH_2843 | HDILTGY | 7 | 7495 |
| PDH_2844 | TDILTGF | 7 | 7496 |
| PDH_2845 | VDILTGY | 7 | 7497 |
| PDH_2846 | LDILTGF | 7 | 7498 |
| PDH_2847 | VDILTGS | 7 | 7499 |
| PDH_2848 | HDILTGS | 7 | 7500 |
| PDH_2849 | ADILTGS | 7 | 7501 |
| PDH_2850 | HDILTGF | 7 | 7502 |
| PDH_2851 | NDILTGS | 7 | 7503 |
| PDH_2852 | NDILTGF | 7 | 7504 |
| PDH_2853 | ADILTGY | 7 | 7505 |
| PDH_2854 | VDILTGF | 7 | 7506 |
| PDH_2855 | TDILTGY | 7 | 7507 |
| PDH_2856 | ADILTGF | 7 | 7508 |
| PDH_2857 | NDILTGY | 7 | 7509 |
| PDH_2858 | TDILTGS | 7 | 7510 |
| PDH_2859 | SDILTGS | 7 | 7511 |
| PDH_2860 | DDILTGY | 7 | 7512 |
| PDH_2861 | SDILTGY | 7 | 7513 |
| PDH_2862 | DDILTGS | 7 | 7514 |
| PDH_2863 | FDILTGY | 7 | 7515 |
| PDH_2864 | SYDFWSA | 7 | 7516 |
| PDH_2865 | FYDFWSG | 7 | 7517 |
| PDH_2866 | IYDFWSD | 7 | 7518 |
| PDH_2867 | LYDFWSD | 7 | 7519 |
| PDH_2868 | AYDFWSD | 7 | 7520 |
| PDH_2869 | IYDFWSA | 7 | 7521 |
| PDH_2870 | PYDFWSD | 7 | 7522 |
| PDH_2871 | AYDFWSA | 7 | 7523 |
| PDH_2872 | SYDFWSG | 7 | 7524 |
| PDH_2873 | FYDFWSA | 7 | 7525 |
| PDH_2874 | PYDFWSA | 7 | 7526 |
| PDH_2875 | YYDFWSG | 7 | 4248 |
| PDH_2876 | FYDFWSD | 7 | 7527 |
| PDH_2877 | IYDFWSG | 7 | 7528 |
| PDH_2878 | PYDFWSG | 7 | 7529 |
| PDH_2879 | YYDFWSA | 7 | 7530 |
| PDH_2880 | YYDFWSD | 7 | 7531 |
| PDH_2881 | NYDFWSD | 7 | 7532 |
| PDH_2882 | VYDFWSA | 7 | 7533 |
| PDH_2883 | NYDFWSA | 7 | 7534 |
| PDH_2884 | VYDFWSD | 7 | 7535 |
| PDH_2885 | VYDFWSG | 7 | 7536 |
| PDH_2886 | NYDFWSG | 7 | 7537 |
| PDH_2887 | DYDFWSA | 7 | 7538 |
| PDH_2888 | DYDFWSD | 7 | 7539 |
| PDH_2889 | DYDFWSG | 7 | 7540 |
| PDH_2890 | HYDFWSG | 7 | 7541 |
| PDH_2891 | TYDFWSG | 7 | 7542 |
| PDH_2892 | HYDFWSA | 7 | 7543 |
| PDH_2893 | LYDFWSG | 7 | 7544 |
| PDH_2894 | HYDFWSD | 7 | 7545 |
| PDH_2895 | TYDFWSA | 7 | 7546 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2896 | SYDFWSD | 7 | 7547 |
| PDH_2897 | TYDFWSD | 7 | 7548 |
| PDH_2898 | LYDFWSA | 7 | 7549 |
| PDH_2899 | AYDFWSG | 7 | 7550 |
| PDH_2900 | SCSSTSC | 7 | 7551 |
| PDH_2901 | HCSSTSC | 7 | 7552 |
| PDH_2902 | PCSSTSC | 7 | 7553 |
| PDH_2903 | ACSSTSC | 7 | 7554 |
| PDH_2904 | VCSSTSC | 7 | 7555 |
| PDH_2905 | LCSSTSC | 7 | 7556 |
| PDH_2906 | YCSSTSC | 7 | 3812 |
| PDH_2907 | FCSSTSC | 7 | 7557 |
| PDH_2908 | DCSSTSC | 7 | 7558 |
| PDH_2909 | RYSSSWS | 7 | 7559 |
| PDH_2910 | VYSSSWY | 7 | 7560 |
| PDH_2911 | GYSSSWY | 7 | 4435 |
| PDH_2912 | VYSSSWS | 7 | 7561 |
| PDH_2913 | TYSSSWY | 7 | 7562 |
| PDH_2914 | TYSSSWF | 7 | 7563 |
| PDH_2915 | TYSSSWS | 7 | 7564 |
| PDH_2916 | GYSSSWF | 7 | 7565 |
| PDH_2917 | LYSSSWF | 7 | 7566 |
| PDH_2918 | AYSSSWS | 7 | 7567 |
| PDH_2919 | SYSSSWF | 7 | 7568 |
| PDH_2920 | WYSSSWS | 7 | 7569 |
| PDH_2921 | WYSSSWF | 7 | 7570 |
| PDH_2922 | MYSSSWS | 7 | 7571 |
| PDH_2923 | SYSSSWS | 7 | 7572 |
| PDH_2924 | LYSSSWY | 7 | 7573 |
| PDH_2925 | AYSSSWY | 7 | 7574 |
| PDH_2926 | AYSSSWF | 7 | 7575 |
| PDH_2927 | LYSSSWS | 7 | 7576 |
| PDH_2928 | WYSSSWY | 7 | 7577 |
| PDH_2929 | VYSSSWF | 7 | 7578 |
| PDH_2930 | SYSSSWY | 7 | 7579 |
| PDH_2931 | RYSSSWF | 7 | 7580 |
| PDH_2932 | MYSSSWF | 7 | 7581 |
| PDH_2933 | RYSSSWY | 7 | 7582 |
| PDH_2934 | MYSSSWY | 7 | 7583 |
| PDH_2935 | GYSSSWS | 7 | 7584 |
| PDH_2936 | IYDSSGY | 7 | 7585 |
| PDH_2937 | PYDSSGS | 7 | 7586 |
| PDH_2938 | VYDSSGF | 7 | 7587 |
| PDH_2939 | PYDSSGY | 7 | 7588 |
| PDH_2940 | NYDSSGS | 7 | 7589 |
| PDH_2941 | LYDSSGY | 7 | 7590 |
| PDH_2942 | NYDSSGY | 7 | 7591 |
| PDH_2943 | LYDSSGS | 7 | 7592 |
| PDH_2944 | VYDSSGY | 7 | 7593 |
| PDH_2945 | VYDSSGS | 7 | 7594 |
| PDH_2946 | LYDSSGF | 7 | 7595 |
| PDH_2947 | NYDSSGF | 7 | 7596 |
| PDH_2948 | YYDSSGY | 7 | 4168 |
| PDH_2949 | YYDSSGS | 7 | 7597 |
| PDH_2950 | DYDSSGS | 7 | 7598 |
| PDH_2951 | TYDSSGY | 7 | 7599 |
| PDH_2952 | TYDSSGF | 7 | 7600 |
| PDH_2953 | TYDSSGS | 7 | 7601 |
| PDH_2954 | YYDSSGF | 7 | 7602 |
| PDH_2955 | AYDSSGS | 7 | 7603 |
| PDH_2956 | HYDSSGY | 7 | 7604 |
| PDH_2957 | AYDSSGY | 7 | 7605 |
| PDH_2958 | HYDSSGF | 7 | 7606 |
| PDH_2959 | HYDSSGS | 7 | 7607 |
| PDH_2960 | FYDSSGF | 7 | 7608 |
| PDH_2961 | IYDSSGF | 7 | 7609 |
| PDH_2962 | DYDSSGY | 7 | 7610 |
| PDH_2963 | DYDSSGF | 7 | 7611 |
| PDH_2964 | PYDSSGF | 7 | 7612 |
| PDH_2965 | SYDSSGS | 7 | 7613 |
| PDH_2966 | SYDSSGF | 7 | 7614 |
| PDH_2967 | AYDSSGF | 7 | 7615 |
| PDH_2968 | FYDSSGY | 7 | 7616 |
| PDH_2969 | SYDSSGY | 7 | 7617 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_2970 | IYDSSGS | 7 | 7618 |
| PDH_2971 | FYDSSGS | 7 | 7619 |
| PDH_2972 | HYYGSGI | 7 | 7620 |
| PDH_2973 | SYYGSGI | 7 | 7621 |
| PDH_2974 | AYYGSGT | 7 | 7622 |
| PDH_2975 | DYYGSGI | 7 | 7623 |
| PDH_2976 | VYYGSGT | 7 | 7624 |
| PDH_2977 | AYYGSGS | 7 | 7625 |
| PDH_2978 | VYYGSGI | 7 | 7626 |
| PDH_2979 | VYYGSGS | 7 | 7627 |
| PDH_2980 | HYYGSGS | 7 | 7628 |
| PDH_2981 | LYYGSGS | 7 | 7629 |
| PDH_2982 | HYYGSGT | 7 | 7630 |
| PDH_2983 | LYYGSGT | 7 | 7631 |
| PDH_2984 | PYYGSGS | 7 | 7632 |
| PDH_2985 | SYYGSGS | 7 | 7633 |
| PDH_2986 | NYYGSGS | 7 | 7634 |
| PDH_2987 | IYYGSGS | 7 | 7635 |
| PDH_2988 | DYYGSGT | 7 | 7636 |
| PDH_2989 | PYYGSGI | 7 | 7637 |
| PDH_2990 | PYYGSGT | 7 | 7638 |
| PDH_2991 | SYYGSGT | 7 | 7639 |
| PDH_2992 | FYYGSGS | 7 | 7640 |
| PDH_2993 | YYYGSGS | 7 | 3975 |
| PDH_2994 | NYYGSGT | 7 | 7641 |
| PDH_2995 | IYYGSGT | 7 | 7642 |
| PDH_2996 | DYYGSGS | 7 | 7643 |
| PDH_2997 | TYYGSGS | 7 | 7644 |
| PDH_2998 | FYYGSGT | 7 | 7645 |
| PDH_2999 | YYYGSGT | 7 | 7646 |
| PDH_3000 | TYYGSGT | 7 | 7647 |
| PDH_3001 | YYYGSGI | 7 | 7648 |
| PDH_3002 | FYYGSGI | 7 | 7649 |
| PDH_3003 | AYYGSGI | 7 | 7650 |
| PDH_3004 | TYYGSGI | 7 | 7651 |
| PDH_3005 | IYYGSGI | 7 | 7652 |
| PDH_3006 | LYYGSGI | 7 | 7653 |
| PDH_3007 | NYYGSGI | 7 | 7654 |
| PDH_3008 | TYSSGWF | 7 | 7655 |
| PDH_3009 | TYSSGWS | 7 | 7656 |
| PDH_3010 | VYSSGWF | 7 | 7657 |
| PDH_3011 | GYSSGWF | 7 | 7658 |
| PDH_3012 | MYSSGWS | 7 | 7659 |
| PDH_3013 | SYSSGWF | 7 | 7660 |
| PDH_3014 | MYSSGWY | 7 | 7661 |
| PDH_3015 | LYSSGWY | 7 | 7662 |
| PDH_3016 | MYSSGWF | 7 | 7663 |
| PDH_3017 | WYSSGWS | 7 | 7664 |
| PDH_3018 | WYSSGWY | 7 | 7665 |
| PDH_3019 | AYSSGWS | 7 | 7666 |
| PDH_3020 | RYSSGWF | 7 | 7667 |
| PDH_3021 | LYSSGWF | 7 | 7668 |
| PDH_3022 | AYSSGWY | 7 | 7669 |
| PDH_3023 | RYSSGWY | 7 | 7670 |
| PDH_3024 | SYSSGWY | 7 | 7671 |
| PDH_3025 | RYSSGWS | 7 | 7672 |
| PDH_3026 | GYSSGWY | 7 | 4456 |
| PDH_3027 | WYSSGWF | 7 | 7673 |
| PDH_3028 | AYSSGWF | 7 | 7674 |
| PDH_3029 | GYSSGWS | 7 | 7675 |
| PDH_3030 | VYSSGWY | 7 | 7676 |
| PDH_3031 | VYSSGWS | 7 | 7677 |
| PDH_3032 | LYSSGWS | 7 | 7678 |
| PDH_3033 | TYSSGWY | 7 | 7679 |
| PDH_3034 | SYSSGWS | 7 | 7680 |
| PDH_3035 | FCSGGSC | 7 | 7681 |
| PDH_3036 | LCSGGSC | 7 | 7682 |
| PDH_3037 | SCSGGSC | 7 | 7683 |
| PDH_3038 | YCSGGSC | 7 | 3773 |
| PDH_3039 | DCSGGSC | 7 | 7684 |
| PDH_3040 | HCSGGSC | 7 | 7685 |
| PDH_3041 | PCSGGSC | 7 | 7686 |
| PDH_3042 | ACSGGSC | 7 | 7687 |
| PDH_3043 | VCSGGSC | 7 | 7688 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3044 | CSGGSCH | 7 | 7689 |
| PDH_3045 | CSGGSCL | 7 | 7690 |
| PDH_3046 | CSGGSCS | 7 | 7691 |
| PDH_3047 | CSGGSCY | 7 | 3774 |
| PDH_3048 | CSGGSCP | 7 | 7692 |
| PDH_3049 | CSGGSCF | 7 | 7693 |
| PDH_3050 | CSSTSCY | 7 | 3813 |
| PDH_3051 | CSSTSCL | 7 | 7694 |
| PDH_3052 | CSSTSCF | 7 | 7695 |
| PDH_3053 | CSSTSCH | 7 | 7696 |
| PDH_3054 | CSSTSCS | 7 | 7697 |
| PDH_3055 | CSSTSCP | 7 | 7698 |
| PDH_3056 | ICGGDCF | 7 | 7699 |
| PDH_3057 | VCGGDCS | 7 | 7700 |
| PDH_3058 | DCGGDCF | 7 | 7701 |
| PDH_3059 | SCGGDCF | 7 | 7702 |
| PDH_3060 | NCGGDCY | 7 | 7703 |
| PDH_3061 | VCGGDCY | 7 | 7704 |
| PDH_3062 | SCGGDCS | 7 | 7705 |
| PDH_3063 | NCGGDCS | 7 | 7706 |
| PDH_3064 | HCGGDCF | 7 | 7707 |
| PDH_3065 | LCGGDCS | 7 | 7708 |
| PDH_3066 | LCGGDCY | 7 | 7709 |
| PDH_3067 | ICGGDCY | 7 | 7710 |
| PDH_3068 | LCGGDCF | 7 | 7711 |
| PDH_3069 | ICGGDCS | 7 | 7712 |
| PDH_3070 | VCGGDCF | 7 | 7713 |
| PDH_3071 | HCGGDCS | 7 | 7714 |
| PDH_3072 | YCGGDCF | 7 | 7715 |
| PDH_3073 | HCGGDCY | 7 | 7716 |
| PDH_3074 | FCGGDCF | 7 | 7717 |
| PDH_3075 | YCGGDCS | 7 | 7718 |
| PDH_3076 | DCGGDCS | 7 | 7719 |
| PDH_3077 | YCGGDCY | 7 | 3866 |
| PDH_3078 | DCGGDCY | 7 | 7720 |
| PDH_3079 | PCGGDCF | 7 | 7721 |
| PDH_3080 | FCGGDCS | 7 | 7722 |
| PDH_3081 | FCGGDCY | 7 | 7723 |
| PDH_3082 | ACGGDCF | 7 | 7724 |
| PDH_3083 | ACGGDCY | 7 | 7725 |
| PDH_3084 | ACGGDCS | 7 | 7726 |
| PDH_3085 | PCGGDCY | 7 | 7727 |
| PDH_3086 | PCGGDCS | 7 | 7728 |
| PDH_3087 | SCGGDCY | 7 | 7729 |
| PDH_3088 | NCGGDCF | 7 | 7730 |
| PDH_3089 | TCGGDCS | 7 | 7731 |
| PDH_3090 | TCGGDCY | 7 | 7732 |
| PDH_3091 | TCGGDCF | 7 | 7733 |
| PDH_3092 | NDFWSGF | 7 | 7734 |
| PDH_3093 | HDFWSGF | 7 | 7735 |
| PDH_3094 | SDFWSGF | 7 | 7736 |
| PDH_3095 | NDFWSGY | 7 | 7737 |
| PDH_3096 | HDFWSGS | 7 | 7738 |
| PDH_3097 | DDFWSGF | 7 | 7739 |
| PDH_3098 | HDFWSGY | 7 | 7740 |
| PDH_3099 | SDFWSGY | 7 | 7741 |
| PDH_3100 | FDFWSGF | 7 | 7742 |
| PDH_3101 | PDFWSGY | 7 | 7743 |
| PDH_3102 | IDFWSGF | 7 | 7744 |
| PDH_3103 | SDFWSGS | 7 | 7745 |
| PDH_3104 | PDFWSGS | 7 | 7746 |
| PDH_3105 | TDFWSGF | 7 | 7747 |
| PDH_3106 | LDFWSGS | 7 | 7748 |
| PDH_3107 | DDFWSGY | 7 | 7749 |
| PDH_3108 | LDFWSGY | 7 | 7750 |
| PDH_3109 | FDFWSGS | 7 | 7751 |
| PDH_3110 | ADFWSGF | 7 | 7752 |
| PDH_3111 | FDFWSGY | 7 | 7753 |
| PDH_3112 | TDFWSGS | 7 | 7754 |
| PDH_3113 | PDFWSGF | 7 | 7755 |
| PDH_3114 | VDFWSGF | 7 | 7756 |
| PDH_3115 | TDFWSGY | 7 | 7757 |
| PDH_3116 | IDFWSGY | 7 | 7758 |
| PDH_3117 | DDFWSGS | 7 | 7759 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3118 | YDFWSGS | 7 | 7760 |
| PDH_3119 | YDFWSGF | 7 | 7761 |
| PDH_3120 | IDFWSGS | 7 | 7762 |
| PDH_3121 | NDFWSGS | 7 | 7763 |
| PDH_3122 | YDFWSGY | 7 | 4249 |
| PDH_3123 | LDFWSGF | 7 | 7764 |
| PDH_3124 | ADFWSGY | 7 | 7765 |
| PDH_3125 | VDFWSGS | 7 | 7766 |
| PDH_3126 | ADFWSGS | 7 | 7767 |
| PDH_3127 | VDFWSGY | 7 | 7768 |
| PDH_3128 | YDSSGYS | 7 | 7769 |
| PDH_3129 | VDSSGYF | 7 | 7770 |
| PDH_3130 | VDSSGYS | 7 | 7771 |
| PDH_3131 | ADSSGYS | 7 | 7772 |
| PDH_3132 | HDSSGYF | 7 | 7773 |
| PDH_3133 | ADSSGYY | 7 | 7774 |
| PDH_3134 | DDSSGYY | 7 | 7775 |
| PDH_3135 | DDSSGYS | 7 | 7776 |
| PDH_3136 | SDSSGYS | 7 | 7777 |
| PDH_3137 | SDSSGYF | 7 | 7778 |
| PDH_3138 | PDSSGYS | 7 | 7779 |
| PDH_3139 | SDSSGYY | 7 | 7780 |
| PDH_3140 | PDSSGYY | 7 | 7781 |
| PDH_3141 | HDSSGYY | 7 | 7782 |
| PDH_3142 | PDSSGYF | 7 | 7783 |
| PDH_3143 | FDSSGYF | 7 | 7784 |
| PDH_3144 | HDSSGYS | 7 | 7785 |
| PDH_3145 | ADSSGYF | 7 | 7786 |
| PDH_3146 | DDSSGYF | 7 | 7787 |
| PDH_3147 | LDSSGYF | 7 | 7788 |
| PDH_3148 | LDSSGYY | 7 | 7789 |
| PDH_3149 | LDSSGYS | 7 | 7790 |
| PDH_3150 | FDSSGYY | 7 | 7791 |
| PDH_3151 | FDSSGYS | 7 | 7792 |
| PDH_3152 | YDSSGYF | 7 | 7793 |
| PDH_3153 | YDSSGYY | 7 | 4169 |
| PDH_3154 | VDSSGYY | 7 | 7794 |
| PDH_3155 | EYCGGDC | 7 | 7795 |
| PDH_3156 | QYCGGDC | 7 | 7796 |
| PDH_3157 | AYCGGDC | 7 | 3865 |
| PDH_3158 | IYCGGDC | 7 | 7797 |
| PDH_3159 | TYCGGDC | 7 | 7798 |
| PDH_3160 | PYCGGDC | 7 | 7799 |
| PDH_3161 | LYCGGDC | 7 | 7800 |
| PDH_3162 | VYCGGDC | 7 | 7801 |
| PDH_3163 | KYCGGDC | 7 | 7802 |
| PDH_3164 | VYYDSSGF | 8 | 7803 |
| PDH_3165 | IYYDSSGF | 8 | 7804 |
| PDH_3166 | YYYDSSGY | 8 | 4164 |
| PDH_3167 | PYYDSSGF | 8 | 7805 |
| PDH_3168 | HYYDSSGF | 8 | 7806 |
| PDH_3169 | HYYDSSGY | 8 | 7807 |
| PDH_3170 | AYYDSSGF | 8 | 7808 |
| PDH_3171 | HYYDSSGS | 8 | 7809 |
| PDH_3172 | DYYDSSGY | 8 | 7810 |
| PDH_3173 | DYYDSSGS | 8 | 7811 |
| PDH_3174 | YYYDSSGS | 8 | 7812 |
| PDH_3175 | SYYDSSGF | 8 | 7813 |
| PDH_3176 | LYYDSSGF | 8 | 7814 |
| PDH_3177 | NYYDSSGF | 8 | 7815 |
| PDH_3178 | NYYDSSGY | 8 | 7816 |
| PDH_3179 | IYYDSSGY | 8 | 7817 |
| PDH_3180 | SYYDSSGS | 8 | 7818 |
| PDH_3181 | AYYDSSGS | 8 | 7819 |
| PDH_3182 | IYYDSSGS | 8 | 7820 |
| PDH_3183 | AYYDSSGY | 8 | 7821 |
| PDH_3184 | DYYDSSGF | 8 | 7822 |
| PDH_3185 | SYYDSSGY | 8 | 7823 |
| PDH_3186 | NYYDSSGS | 8 | 7824 |
| PDH_3187 | LYYDSSGY | 8 | 7825 |
| PDH_3188 | PYYDSSGS | 8 | 7826 |
| PDH_3189 | LYYDSSGS | 8 | 7827 |
| PDH_3190 | PYYDSSGY | 8 | 7828 |
| PDH_3191 | TYYDSSGY | 8 | 7829 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3192 | TYYDSSGS | 8 | 7830 |
| PDH_3193 | FYYDSSGF | 8 | 7831 |
| PDH_3194 | FYYDSSGY | 8 | 7832 |
| PDH_3195 | FYYDSSGS | 8 | 7833 |
| PDH_3196 | VYYDSSGS | 8 | 7834 |
| PDH_3197 | TYYDSSGF | 8 | 7835 |
| PDH_3198 | YYYDSSGF | 8 | 7836 |
| PDH_3199 | VYYDSSGY | 8 | 7837 |
| PDH_3200 | TYYGSGSS | 8 | 7838 |
| PDH_3201 | SYYGSGSY | 8 | 7839 |
| PDH_3202 | SYYGSGSS | 8 | 7840 |
| PDH_3203 | HYYGSGSF | 8 | 7841 |
| PDH_3204 | PYYGSGSF | 8 | 7842 |
| PDH_3205 | AYYGSGSS | 8 | 7843 |
| PDH_3206 | AYYGSGSF | 8 | 7844 |
| PDH_3207 | AYYGSGSY | 8 | 7845 |
| PDH_3208 | YYYGSGSF | 8 | 7846 |
| PDH_3209 | TYYGSGSY | 8 | 7847 |
| PDH_3210 | YYYGSGSY | 8 | 3972 |
| PDH_3211 | PYYGSGSS | 8 | 7848 |
| PDH_3212 | PYYGSGSY | 8 | 7849 |
| PDH_3213 | DYYGSGSY | 8 | 7850 |
| PDH_3214 | VYYGSGSY | 8 | 7851 |
| PDH_3215 | VYYGSGSF | 8 | 7852 |
| PDH_3216 | YYYGSGSS | 8 | 7853 |
| PDH_3217 | LYYGSGSF | 8 | 7854 |
| PDH_3218 | LYYGSGSY | 8 | 7855 |
| PDH_3219 | DYYGSGSS | 8 | 7856 |
| PDH_3220 | VYYGSGSS | 8 | 7857 |
| PDH_3221 | IYYGSGSS | 8 | 7858 |
| PDH_3222 | FYYGSGSY | 8 | 7859 |
| PDH_3223 | FYYGSGSS | 8 | 7860 |
| PDH_3224 | LYYGSGSS | 8 | 7861 |
| PDH_3225 | SYYGSGSF | 8 | 7862 |
| PDH_3226 | IYYGSGSY | 8 | 7863 |
| PDH_3227 | IYYGSGSF | 8 | 7864 |
| PDH_3228 | FYYGSGSF | 8 | 7865 |
| PDH_3229 | DYYGSGSF | 8 | 7866 |
| PDH_3230 | NYYGSGSS | 8 | 7867 |
| PDH_3231 | NYYGSGSY | 8 | 7868 |
| PDH_3232 | TYYGSGSF | 8 | 7869 |
| PDH_3233 | HYYGSGSY | 8 | 7870 |
| PDH_3234 | HYYGSGSS | 8 | 7871 |
| PDH_3235 | NYYGSGSF | 8 | 7872 |
| PDH_3236 | AYCSSTSC | 8 | 7873 |
| PDH_3237 | PYCSSTSC | 8 | 7874 |
| PDH_3238 | RYCSSTSC | 8 | 7875 |
| PDH_3239 | IYCSSTSC | 8 | 7876 |
| PDH_3240 | LYCSSTSC | 8 | 7877 |
| PDH_3241 | VYCSSTSC | 8 | 7878 |
| PDH_3242 | TYCSSTSC | 8 | 7879 |
| PDH_3243 | SYCSSTSC | 8 | 7880 |
| PDH_3244 | GYCSSTSC | 8 | 3809 |
| PDH_3245 | IYCSGGSC | 8 | 7881 |
| PDH_3246 | VYCSGGSC | 8 | 7882 |
| PDH_3247 | LYCSGGSC | 8 | 7883 |
| PDH_3248 | AYCSGGSC | 8 | 7884 |
| PDH_3249 | TYCSGGSC | 8 | 7885 |
| PDH_3250 | GYCSGGSC | 8 | 3770 |
| PDH_3251 | RYCSGGSC | 8 | 7886 |
| PDH_3252 | PYCSGGSC | 8 | 7887 |
| PDH_3253 | SYCSGGSC | 8 | 7888 |
| PDH_3254 | FYDFWSGY | 8 | 7889 |
| PDH_3255 | AYDFWSGF | 8 | 7890 |
| PDH_3256 | NYDFWSGF | 8 | 7891 |
| PDH_3257 | IYDFWSGF | 8 | 7892 |
| PDH_3258 | DYDFWSGS | 8 | 7893 |
| PDH_3259 | DYDFWSGY | 8 | 7894 |
| PDH_3260 | NYDFWSGY | 8 | 7895 |
| PDH_3261 | VYDFWSGF | 8 | 7896 |
| PDH_3262 | VYDFWSGS | 8 | 7897 |
| PDH_3263 | YYDFWSGF | 8 | 7898 |
| PDH_3264 | PYDFWSGF | 8 | 7899 |
| PDH_3265 | FYDFWSGS | 8 | 7900 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3266 | HYDFWSGF | 8 | 7901 |
| PDH_3267 | HYDFWSGY | 8 | 7902 |
| PDH_3268 | YYDFWSGS | 8 | 7903 |
| PDH_3269 | PYDFWSGY | 8 | 7904 |
| PDH_3270 | PYDFWSGS | 8 | 7905 |
| PDH_3271 | VYDFWSGY | 8 | 7906 |
| PDH_3272 | SYDFWSGS | 8 | 7907 |
| PDH_3273 | YYDFWSGY | 8 | 4245 |
| PDH_3274 | LYDFWSGF | 8 | 7908 |
| PDH_3275 | HYDFWSGS | 8 | 7909 |
| PDH_3276 | SYDFWSGY | 8 | 7910 |
| PDH_3277 | SYDFWSGF | 8 | 7911 |
| PDH_3278 | LYDFWSGS | 8 | 7912 |
| PDH_3279 | TYDFWSGF | 8 | 7913 |
| PDH_3280 | LYDFWSGY | 8 | 7914 |
| PDH_3281 | AYDFWSGY | 8 | 7915 |
| PDH_3282 | AYDFWSGS | 8 | 7916 |
| PDH_3283 | TYDFWSGS | 8 | 7917 |
| PDH_3284 | IYDFWSGY | 8 | 7918 |
| PDH_3285 | TYDFWSGY | 8 | 7919 |
| PDH_3286 | NYDFWSGS | 8 | 7920 |
| PDH_3287 | DYDFWSGF | 8 | 7921 |
| PDH_3288 | IYDFWSGS | 8 | 7922 |
| PDH_3289 | FYDFWSGF | 8 | 7923 |
| PDH_3290 | HDILTGYS | 8 | 7924 |
| PDH_3291 | PDILTGYY | 8 | 7925 |
| PDH_3292 | PDILTGYF | 8 | 7926 |
| PDH_3293 | TDILTGYS | 8 | 7927 |
| PDH_3294 | HDILTGYY | 8 | 7928 |
| PDH_3295 | YDILTGYF | 8 | 7929 |
| PDH_3296 | IDILTGYS | 8 | 7930 |
| PDH_3297 | IDILTGYY | 8 | 7931 |
| PDH_3298 | IDILTGYF | 8 | 7932 |
| PDH_3299 | LDILTGYF | 8 | 7933 |
| PDH_3300 | LDILTGYY | 8 | 7934 |
| PDH_3301 | LDILTGYS | 8 | 7935 |
| PDH_3302 | DDILTGYF | 8 | 7936 |
| PDH_3303 | FDILTGYF | 8 | 7937 |
| PDH_3304 | SDILTGYF | 8 | 7938 |
| PDH_3305 | ADILTGYY | 8 | 7939 |
| PDH_3306 | VDILTGYY | 8 | 7940 |
| PDH_3307 | VDILTGYS | 8 | 7941 |
| PDH_3308 | ADILTGYS | 8 | 7942 |
| PDH_3309 | DDILTGYS | 8 | 7943 |
| PDH_3310 | FDILTGYS | 8 | 7944 |
| PDH_3311 | SDILTGYS | 8 | 7945 |
| PDH_3312 | DDILTGYY | 8 | 7946 |
| PDH_3313 | SDILTGYY | 8 | 7947 |
| PDH_3314 | YDILTGYY | 8 | 4322 |
| PDH_3315 | FDILTGYY | 8 | 7948 |
| PDH_3316 | HDILTGYF | 8 | 7949 |
| PDH_3317 | NDILTGYY | 8 | 7950 |
| PDH_3318 | NDILTGYF | 8 | 7951 |
| PDH_3319 | PDILTGYS | 8 | 7952 |
| PDH_3320 | VDILTGYF | 8 | 7953 |
| PDH_3321 | TDILTGYY | 8 | 7954 |
| PDH_3322 | TDILTGYF | 8 | 7955 |
| PDH_3323 | YDILTGYS | 8 | 7956 |
| PDH_3324 | NDILTGYS | 8 | 7957 |
| PDH_3325 | ADILTGYF | 8 | 7958 |
| PDH_3326 | SCSGGSCS | 8 | 7959 |
| PDH_3327 | HCSGGSCF | 8 | 7960 |
| PDH_3328 | DCSGGSCS | 8 | 7961 |
| PDH_3329 | PCSGGSCF | 8 | 7962 |
| PDH_3330 | PCSGGSCY | 8 | 7963 |
| PDH_3331 | SCSGGSCY | 8 | 7964 |
| PDH_3332 | PCSGGSCS | 8 | 7965 |
| PDH_3333 | LCSGGSCY | 8 | 7966 |
| PDH_3334 | ACSGGSCY | 8 | 7967 |
| PDH_3335 | ACSGGSCS | 8 | 7968 |
| PDH_3336 | ACSGGSCF | 8 | 7969 |
| PDH_3337 | VCSGGSCY | 8 | 7970 |
| PDH_3338 | VCSGGSCF | 8 | 7971 |
| PDH_3339 | VCSGGSCS | 8 | 7972 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3340 | YCSGGSCS | 8 | 7973 |
| PDH_3341 | YCSGGSCF | 8 | 7974 |
| PDH_3342 | DCSGGSCF | 8 | 7975 |
| PDH_3343 | DCSGGSCY | 8 | 7976 |
| PDH_3344 | FCSGGSCS | 8 | 7977 |
| PDH_3345 | FCSGGSCY | 8 | 7978 |
| PDH_3346 | FCSGGSCF | 8 | 7979 |
| PDH_3347 | SCSGGSCF | 8 | 7980 |
| PDH_3348 | YCSGGSCY | 8 | 3771 |
| PDH_3349 | LCSGGSCF | 8 | 7981 |
| PDH_3350 | LCSGGSCS | 8 | 7982 |
| PDH_3351 | HCSGGSCS | 8 | 7983 |
| PDH_3352 | HCSGGSCY | 8 | 7984 |
| PDH_3353 | ACSSTSCY | 8 | 7985 |
| PDH_3354 | YCSSTSCF | 8 | 7986 |
| PDH_3355 | FCSSTSCY | 8 | 7987 |
| PDH_3356 | PCSSTSCF | 8 | 7988 |
| PDH_3357 | FCSSTSCS | 8 | 7989 |
| PDH_3358 | DCSSTSCF | 8 | 7990 |
| PDH_3359 | VCSSTSCS | 8 | 7991 |
| PDH_3360 | VCSSTSCF | 8 | 7992 |
| PDH_3361 | LCSSTSCS | 8 | 7993 |
| PDH_3362 | VCSSTSCY | 8 | 7994 |
| PDH_3363 | ACSSTSCS | 8 | 7995 |
| PDH_3364 | LCSSTSCY | 8 | 7996 |
| PDH_3365 | LCSSTSCF | 8 | 7997 |
| PDH_3366 | FCSSTSCF | 8 | 7998 |
| PDH_3367 | HCSSTSCY | 8 | 7999 |
| PDH_3368 | HCSSTSCS | 8 | 8000 |
| PDH_3369 | HCSSTSCF | 8 | 8001 |
| PDH_3370 | SCSSTSCF | 8 | 8002 |
| PDH_3371 | SCSSTSCS | 8 | 8003 |
| PDH_3372 | YCSSTSCS | 8 | 8004 |
| PDH_3373 | DCSSTSCY | 8 | 8005 |
| PDH_3374 | DCSSTSCS | 8 | 8006 |
| PDH_3375 | SCSSTSCY | 8 | 8007 |
| PDH_3376 | PCSSTSCS | 8 | 8008 |
| PDH_3377 | ACSSTSCF | 8 | 8009 |
| PDH_3378 | PCSSTSCY | 8 | 8010 |
| PDH_3379 | YCSSTSCY | 8 | 3810 |
| PDH_3380 | LYCGGDCS | 8 | 8011 |
| PDH_3381 | EYCGGDCS | 8 | 8012 |
| PDH_3382 | LYCGGDCY | 8 | 8013 |
| PDH_3383 | VYCGGDCS | 8 | 8014 |
| PDH_3384 | VYCGGDCY | 8 | 8015 |
| PDH_3385 | AYCGGDCY | 8 | 3863 |
| PDH_3386 | AYCGGDCF | 8 | 8016 |
| PDH_3387 | EYCGGDCY | 8 | 8017 |
| PDH_3388 | TYCGGDCF | 8 | 8018 |
| PDH_3389 | LYCGGDCF | 8 | 8019 |
| PDH_3390 | AYCGGDCS | 8 | 8020 |
| PDH_3391 | QYCGGDCF | 8 | 8021 |
| PDH_3392 | QYCGGDCS | 8 | 8022 |
| PDH_3393 | KYCGGDCF | 8 | 8023 |
| PDH_3394 | KYCGGDCY | 8 | 8024 |
| PDH_3395 | QYCGGDCY | 8 | 8025 |
| PDH_3396 | KYCGGDCS | 8 | 8026 |
| PDH_3397 | VYCGGDCF | 8 | 8027 |
| PDH_3398 | IYCGGDCF | 8 | 8028 |
| PDH_3399 | IYCGGDCY | 8 | 8029 |
| PDH_3400 | IYCGGDCS | 8 | 8030 |
| PDH_3401 | PYCGGDCS | 8 | 8031 |
| PDH_3402 | PYCGGDCF | 8 | 8032 |
| PDH_3403 | TYCGGDCY | 8 | 8033 |
| PDH_3404 | EYCGGDCF | 8 | 8034 |
| PDH_3405 | PYCGGDCY | 8 | 8035 |
| PDH_3406 | TYCGGDCS | 8 | 8036 |
| PDH_3407 | DYDSSGYS | 8 | 8037 |
| PDH_3408 | YYDSSGYF | 8 | 8038 |
| PDH_3409 | LYDSSGYS | 8 | 8039 |
| PDH_3410 | AYDSSGYS | 8 | 8040 |
| PDH_3411 | AYDSSGYY | 8 | 8041 |
| PDH_3412 | NYDSSGYY | 8 | 8042 |
| PDH_3413 | IYDSSGYS | 8 | 8043 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3414 | FYDSSGYF | 8 | 8044 |
| PDH_3415 | DYDSSGYY | 8 | 8045 |
| PDH_3416 | YYDSSGYS | 8 | 8046 |
| PDH_3417 | TYDSSGYY | 8 | 8047 |
| PDH_3418 | TYDSSGYS | 8 | 8048 |
| PDH_3419 | PYDSSGYF | 8 | 8049 |
| PDH_3420 | IYDSSGYY | 8 | 8050 |
| PDH_3421 | IYDSSGYF | 8 | 8051 |
| PDH_3422 | YYDSSGYY | 8 | 4165 |
| PDH_3423 | NYDSSGYS | 8 | 8052 |
| PDH_3424 | NYDSSGYF | 8 | 8053 |
| PDH_3425 | VYDSSGYY | 8 | 8054 |
| PDH_3426 | VYDSSGYF | 8 | 8055 |
| PDH_3427 | FYDSSGYY | 8 | 8056 |
| PDH_3428 | FYDSSGYS | 8 | 8057 |
| PDH_3429 | SYDSSGYY | 8 | 8058 |
| PDH_3430 | SYDSSGYS | 8 | 8059 |
| PDH_3431 | PYDSSGYS | 8 | 8060 |
| PDH_3432 | PYDSSGYY | 8 | 8061 |
| PDH_3433 | LYDSSGYY | 8 | 8062 |
| PDH_3434 | VYDSSGYS | 8 | 8063 |
| PDH_3435 | SYDSSGYF | 8 | 8064 |
| PDH_3436 | LYDSSGYF | 8 | 8065 |
| PDH_3437 | HYDSSGYY | 8 | 8066 |
| PDH_3438 | HYDSSGYS | 8 | 8067 |
| PDH_3439 | TYDSSGYF | 8 | 8068 |
| PDH_3440 | AYDSSGYF | 8 | 8069 |
| PDH_3441 | DYDSSGYF | 8 | 8070 |
| PDH_3442 | HYDSSGYF | 8 | 8071 |
| PDH_3443 | RYYGSGSY | 8 | 8072 |
| PDH_3444 | RYYGSGSS | 8 | 8073 |
| PDH_3445 | GYYGSGSS | 8 | 8074 |
| PDH_3446 | GYYGSGSY | 8 | 8075 |
| PDH_3447 | FDFWSGYS | 8 | 8076 |
| PDH_3448 | HDFWSGYF | 8 | 8077 |
| PDH_3449 | FDFWSGYY | 8 | 8078 |
| PDH_3450 | SDFWSGYS | 8 | 8079 |
| PDH_3451 | SDFWSGYY | 8 | 8080 |
| PDH_3452 | PDFWSGYS | 8 | 8081 |
| PDH_3453 | HDFWSGYS | 8 | 8082 |
| PDH_3454 | IDFWSGYY | 8 | 8083 |
| PDH_3455 | HDFWSGYY | 8 | 8084 |
| PDH_3456 | NDFWSGYF | 8 | 8085 |
| PDH_3457 | YDFWSGYS | 8 | 8086 |
| PDH_3458 | IDFWSGYS | 8 | 8087 |
| PDH_3459 | PDFWSGYY | 8 | 8088 |
| PDH_3460 | SDFWSGYF | 8 | 8089 |
| PDH_3461 | VDFWSGYS | 8 | 8090 |
| PDH_3462 | IDFWSGYF | 8 | 8091 |
| PDH_3463 | YDFWSGYY | 8 | 4246 |
| PDH_3464 | YDFWSGYF | 8 | 8092 |
| PDH_3465 | TDFWSGYY | 8 | 8093 |
| PDH_3466 | DDFWSGYS | 8 | 8094 |
| PDH_3467 | LDFWSGYS | 8 | 8095 |
| PDH_3468 | DDFWSGYY | 8 | 8096 |
| PDH_3469 | DDFWSGYF | 8 | 8097 |
| PDH_3470 | VDFWSGYY | 8 | 8098 |
| PDH_3471 | VDFWSGYF | 8 | 8099 |
| PDH_3472 | NDFWSGYY | 8 | 8100 |
| PDH_3473 | FDFWSGYF | 8 | 8101 |
| PDH_3474 | NDFWSGYS | 8 | 8102 |
| PDH_3475 | LDFWSGYY | 8 | 8103 |
| PDH_3476 | ADFWSGYY | 8 | 8104 |
| PDH_3477 | ADFWSGYS | 8 | 8105 |
| PDH_3478 | TDFWSGYS | 8 | 8106 |
| PDH_3479 | TDFWSGYF | 8 | 8107 |
| PDH_3480 | ADFWSGYF | 8 | 8108 |
| PDH_3481 | LDFWSGYF | 8 | 8109 |
| PDH_3482 | PDFWSGYF | 8 | 8110 |
| PDH_3483 | LLRYFDWY | 8 | 8111 |
| PDH_3484 | QLRYFDWY | 8 | 8112 |
| PDH_3485 | PLRYFDWL | 8 | 8113 |
| PDH_3486 | ILRYFDWF | 8 | 8114 |
| PDH_3487 | ILRYFDWY | 8 | 8115 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3488 | ALRYFDWL | 8 | 8116 |
| PDH_3489 | QLRYFDWF | 8 | 8117 |
| PDH_3490 | KLRYFDWL | 8 | 8118 |
| PDH_3491 | TLRYFDWL | 8 | 8119 |
| PDH_3492 | TLRYFDWH | 8 | 8120 |
| PDH_3493 | ELRYFDWL | 8 | 8121 |
| PDH_3494 | ELRYFDWH | 8 | 8122 |
| PDH_3495 | PLRYFDWH | 8 | 8123 |
| PDH_3496 | ELRYFDWY | 8 | 8124 |
| PDH_3497 | ELRYFDWF | 8 | 8125 |
| PDH_3498 | LLRYFDWL | 8 | 8126 |
| PDH_3499 | VLRYFDWF | 8 | 8127 |
| PDH_3500 | TLRYFDWF | 8 | 8128 |
| PDH_3501 | ALRYFDWF | 8 | 8129 |
| PDH_3502 | ILRYFDWH | 8 | 8130 |
| PDH_3503 | QLRYFDWL | 8 | 8131 |
| PDH_3504 | QLRYFDWH | 8 | 8132 |
| PDH_3505 | VLRYFDWY | 8 | 8133 |
| PDH_3506 | TLRYFDWY | 8 | 8134 |
| PDH_3507 | ILRYFDWL | 8 | 8135 |
| PDH_3508 | LLRYFDWH | 8 | 8136 |
| PDH_3509 | VLRYFDWH | 8 | 8137 |
| PDH_3510 | KLRYFDWY | 8 | 8138 |
| PDH_3511 | KLRYFDWF | 8 | 8139 |
| PDH_3512 | ALRYFDWH | 8 | 8140 |
| PDH_3513 | ALRYFDWY | 8 | 8141 |
| PDH_3514 | VLRYFDWL | 8 | 4298 |
| PDH_3515 | KLRYFDWH | 8 | 8142 |
| PDH_3516 | PLRYFDWY | 8 | 8143 |
| PDH_3517 | PLRYFDWF | 8 | 8144 |
| PDH_3518 | LLRYFDWF | 8 | 8145 |
| PDH_3519 | IYYDSSGYS | 9 | 8146 |
| PDH_3520 | TYYDSSGYS | 9 | 8147 |
| PDH_3521 | HYYDSSGYY | 9 | 8148 |
| PDH_3522 | TYYDSSGYY | 9 | 8149 |
| PDH_3523 | HYYDSSGYS | 9 | 8150 |
| PDH_3524 | NYYDSSGYF | 9 | 8151 |
| PDH_3525 | AYYDSSGYS | 9 | 8152 |
| PDH_3526 | DYYDSSGYF | 9 | 8153 |
| PDH_3527 | DYYDSSGYS | 9 | 8154 |
| PDH_3528 | LYYDSSGYS | 9 | 8155 |
| PDH_3529 | NYYDSSGYS | 9 | 8156 |
| PDH_3530 | HYYDSSGYF | 9 | 8157 |
| PDH_3531 | DYYDSSGYY | 9 | 8158 |
| PDH_3532 | LYYDSSGYY | 9 | 8159 |
| PDH_3533 | IYYDSSGYY | 9 | 8160 |
| PDH_3534 | LYYDSSGYF | 9 | 8161 |
| PDH_3535 | IYYDSSGYF | 9 | 8162 |
| PDH_3536 | AYYDSSGYF | 9 | 8163 |
| PDH_3537 | AYYDSSGYY | 9 | 8164 |
| PDH_3538 | FYYDSSGYS | 9 | 8165 |
| PDH_3539 | YYYDSSGYS | 9 | 8166 |
| PDH_3540 | FYYDSSGYY | 9 | 8167 |
| PDH_3541 | FYYDSSGYF | 9 | 8168 |
| PDH_3542 | YYYDSSGYY | 9 | 4162 |
| PDH_3543 | YYYDSSGYF | 9 | 8169 |
| PDH_3544 | VYYDSSGYF | 9 | 8170 |
| PDH_3545 | PYYDSSGYY | 9 | 8171 |
| PDH_3546 | PYYDSSGYS | 9 | 8172 |
| PDH_3547 | VYYDSSGYS | 9 | 8173 |
| PDH_3548 | SYYDSSGYY | 9 | 8174 |
| PDH_3549 | NYYDSSGYY | 9 | 8175 |
| PDH_3550 | VYYDSSGYY | 9 | 8176 |
| PDH_3551 | SYYDSSGYS | 9 | 8177 |
| PDH_3552 | SYYDSSGYF | 9 | 8178 |
| PDH_3553 | TYYDSSGYF | 9 | 8179 |
| PDH_3554 | PYYDSSGYF | 9 | 8180 |
| PDH_3555 | PYCSGGSCF | 9 | 8181 |
| PDH_3556 | TYCSGGSCF | 9 | 8182 |
| PDH_3557 | IYCSGGSCF | 9 | 8183 |
| PDH_3558 | VYCSGGSCS | 9 | 8184 |
| PDH_3559 | TYCSGGSCY | 9 | 8185 |
| PDH_3560 | VYCSGGSCF | 9 | 8186 |
| PDH_3561 | TYCSGGSCS | 9 | 8187 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3562 | GYCSGGSCS | 9 | 8188 |
| PDH_3563 | IYCSGGSCS | 9 | 8189 |
| PDH_3564 | GYCSGGSCY | 9 | 3768 |
| PDH_3565 | IYCSGGSCY | 9 | 8190 |
| PDH_3566 | VYCSGGSCY | 9 | 8191 |
| PDH_3567 | AYCSGGSCF | 9 | 8192 |
| PDH_3568 | GYCSGGSCF | 9 | 8193 |
| PDH_3569 | LYCSGGSCF | 9 | 8194 |
| PDH_3570 | RYCSGGSCF | 9 | 8195 |
| PDH_3571 | LYCSGGSCS | 9 | 8196 |
| PDH_3572 | RYCSGGSCY | 9 | 8197 |
| PDH_3573 | AYCSGGSCS | 9 | 8198 |
| PDH_3574 | SYCSGGSCY | 9 | 8199 |
| PDH_3575 | SYCSGGSCF | 9 | 8200 |
| PDH_3576 | AYCSGGSCY | 9 | 8201 |
| PDH_3577 | SYCSGGSCS | 9 | 8202 |
| PDH_3578 | PYCSGGSCS | 9 | 8203 |
| PDH_3579 | LYCSGGSCY | 9 | 8204 |
| PDH_3580 | RYCSGGSCS | 9 | 8205 |
| PDH_3581 | PYCSGGSCY | 9 | 8206 |
| PDH_3582 | TYCSSTSCY | 9 | 8207 |
| PDH_3583 | AYCSSTSCY | 9 | 8208 |
| PDH_3584 | AYCSSTSCS | 9 | 8209 |
| PDH_3585 | RYCSSTSCS | 9 | 8210 |
| PDH_3586 | TYCSSTSCS | 9 | 8211 |
| PDH_3587 | PYCSSTSCY | 9 | 8212 |
| PDH_3588 | PYCSSTSCS | 9 | 8213 |
| PDH_3589 | RYCSSTSCY | 9 | 8214 |
| PDH_3590 | VYCSSTSCS | 9 | 8215 |
| PDH_3591 | VYCSSTSCY | 9 | 8216 |
| PDH_3592 | LYCSSTSCF | 9 | 8217 |
| PDH_3593 | LYCSSTSCY | 9 | 8218 |
| PDH_3594 | PYCSSTSCF | 9 | 8219 |
| PDH_3595 | VYCSSTSCF | 9 | 8220 |
| PDH_3596 | IYCSSTSCY | 9 | 8221 |
| PDH_3597 | IYCSSTSCS | 9 | 8222 |
| PDH_3598 | IYCSSTSCF | 9 | 8223 |
| PDH_3599 | SYCSSTSCS | 9 | 8224 |
| PDH_3600 | LYCSSTSCS | 9 | 8225 |
| PDH_3601 | SYCSSTSCY | 9 | 8226 |
| PDH_3602 | SYCSSTSCF | 9 | 8227 |
| PDH_3603 | GYCSSTSCY | 9 | 3807 |
| PDH_3604 | GYCSSTSCF | 9 | 8228 |
| PDH_3605 | GYCSSTSCS | 9 | 8229 |
| PDH_3606 | RYCSSTSCF | 9 | 8230 |
| PDH_3607 | TYCSSTSCF | 9 | 8231 |
| PDH_3608 | AYCSSTSCF | 9 | 8232 |
| PDH_3609 | IYDFWSGYY | 9 | 8233 |
| PDH_3610 | NYDFWSGYY | 9 | 8234 |
| PDH_3611 | PYDFWSGYF | 9 | 8235 |
| PDH_3612 | SYDFWSGYF | 9 | 8236 |
| PDH_3613 | VYDFWSGYF | 9 | 8237 |
| PDH_3614 | VYDFWSGYY | 9 | 8238 |
| PDH_3615 | HYDFWSGYY | 9 | 8239 |
| PDH_3616 | HYDFWSGYF | 9 | 8240 |
| PDH_3617 | HYDFWSGYS | 9 | 8241 |
| PDH_3618 | IYDFWSGYS | 9 | 8242 |
| PDH_3619 | NYDFWSGYS | 9 | 8243 |
| PDH_3620 | AYDFWSGYS | 9 | 8244 |
| PDH_3621 | SYDFWSGYS | 9 | 8245 |
| PDH_3622 | PYDFWSGYS | 9 | 8246 |
| PDH_3623 | AYDFWSGYY | 9 | 8247 |
| PDH_3624 | SYDFWSGYY | 9 | 8248 |
| PDH_3625 | PYDFWSGYY | 9 | 8249 |
| PDH_3626 | FYDFWSGYY | 9 | 8250 |
| PDH_3627 | FYDFWSGYF | 9 | 8251 |
| PDH_3628 | DYDFWSGYS | 9 | 8252 |
| PDH_3629 | FYDFWSGYS | 9 | 8253 |
| PDH_3630 | DYDFWSGYF | 9 | 8254 |
| PDH_3631 | LYDFWSGYY | 9 | 8255 |
| PDH_3632 | AYDFWSGYF | 9 | 8256 |
| PDH_3633 | LYDFWSGYS | 9 | 8257 |
| PDH_3634 | DYDFWSGYY | 9 | 8258 |
| PDH_3635 | LYDFWSGYF | 9 | 8259 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3636 | YYDFWSGYY | 9 | 4243 |
| PDH_3637 | TYDFWSGYY | 9 | 8260 |
| PDH_3638 | TYDFWSGYF | 9 | 8261 |
| PDH_3639 | YYDFWSGYS | 9 | 8262 |
| PDH_3640 | YYDFWSGYF | 9 | 8263 |
| PDH_3641 | TYDFWSGYS | 9 | 8264 |
| PDH_3642 | VYDFWSGYS | 9 | 8265 |
| PDH_3643 | NYDFWSGYF | 9 | 8266 |
| PDH_3644 | IYDFWSGYF | 9 | 8267 |
| PDH_3645 | FCSGGSCYS | 9 | 8268 |
| PDH_3646 | LCSGGSCYS | 9 | 8269 |
| PDH_3647 | VCSGGSCYS | 9 | 8270 |
| PDH_3648 | ACSGGSCYS | 9 | 8271 |
| PDH_3649 | ACSGGSCYY | 9 | 8272 |
| PDH_3650 | FCSGGSCYY | 9 | 8273 |
| PDH_3651 | LCSGGSCYF | 9 | 8274 |
| PDH_3652 | LCSGGSCYY | 9 | 8275 |
| PDH_3653 | VCSGGSCYY | 9 | 8276 |
| PDH_3654 | YCSGGSCYS | 9 | 3769 |
| PDH_3655 | PCSGGSCYS | 9 | 8277 |
| PDH_3656 | PCSGGSCYY | 9 | 8278 |
| PDH_3657 | PCSGGSCYF | 9 | 8279 |
| PDH_3658 | YCSGGSCYF | 9 | 8280 |
| PDH_3659 | YCSGGSCYY | 9 | 8281 |
| PDH_3660 | SCSGGSCYY | 9 | 8282 |
| PDH_3661 | HCSGGSCYF | 9 | 8283 |
| PDH_3662 | DCSGGSCYY | 9 | 8284 |
| PDH_3663 | SCSGGSCYF | 9 | 8285 |
| PDH_3664 | DCSGGSCYS | 9 | 8286 |
| PDH_3665 | HCSGGSCYS | 9 | 8287 |
| PDH_3666 | SCSGGSCYS | 9 | 8288 |
| PDH_3667 | FCSGGSCYF | 9 | 8289 |
| PDH_3668 | ACSGGSCYF | 9 | 8290 |
| PDH_3669 | DCSGGSCYF | 9 | 8291 |
| PDH_3670 | HCSGGSCYY | 9 | 8292 |
| PDH_3671 | VCSGGSCYF | 9 | 8293 |
| PDH_3672 | FYYDSSGYYY | 10 | 8294 |
| PDH_3673 | YYYDSSGYYF | 10 | 8295 |
| PDH_3674 | PYYDSSGYYY | 10 | 8296 |
| PDH_3675 | VYYDSSGYYS | 10 | 8297 |
| PDH_3676 | PYYDSSGYYS | 10 | 8298 |
| PDH_3677 | FYYDSSGYYS | 10 | 8299 |
| PDH_3678 | NYYDSSGYYY | 10 | 8300 |
| PDH_3679 | NYYDSSGYYS | 10 | 8301 |
| PDH_3680 | DYYDSSGYYS | 10 | 8302 |
| PDH_3681 | HYYDSSGYYF | 10 | 8303 |
| PDH_3682 | DYYDSSGYYY | 10 | 8304 |
| PDH_3683 | NYYDSSGYYF | 10 | 8305 |
| PDH_3684 | HYYDSSGYYY | 10 | 8306 |
| PDH_3685 | LYYDSSGYYF | 10 | 8307 |
| PDH_3686 | IYYDSSGYYS | 10 | 8308 |
| PDH_3687 | YYYDSSGYYS | 10 | 8309 |
| PDH_3688 | IYYDSSGYYF | 10 | 8310 |
| PDH_3689 | YYYDSSGYYY | 10 | 4161 |
| PDH_3690 | HYYDSSGYYS | 10 | 8311 |
| PDH_3691 | TYYDSSGYYS | 10 | 8312 |
| PDH_3692 | IYYDSSGYYY | 10 | 8313 |
| PDH_3693 | TYYDSSGYYF | 10 | 8314 |
| PDH_3694 | LYYDSSGYYS | 10 | 8315 |
| PDH_3695 | TYYDSSGYYY | 10 | 8316 |
| PDH_3696 | LYYDSSGYYY | 10 | 8317 |
| PDH_3697 | AYYDSSGYYF | 10 | 8318 |
| PDH_3698 | FYYDSSGYYF | 10 | 8319 |
| PDH_3699 | AYYDSSGYYY | 10 | 8320 |
| PDH_3700 | VYYDSSGYYY | 10 | 8321 |
| PDH_3701 | SYYDSSGYYF | 10 | 8322 |
| PDH_3702 | PYYDSSGYYF | 10 | 8323 |
| PDH_3703 | SYYDSSGYYY | 10 | 8324 |
| PDH_3704 | AYYDSSGYYS | 10 | 8325 |
| PDH_3705 | DYYDSSGYYF | 10 | 8326 |
| PDH_3706 | SYYDSSGYYS | 10 | 8327 |
| PDH_3707 | VYYDSSGYYF | 10 | 8328 |
| PDH_3708 | IYDYVWGSYAS | 11 | 8329 |
| PDH_3709 | AYDYVWGSYAS | 11 | 8330 |

TABLE 28-continued

Theoretical segment pool of unique DH polypeptide segments encoded by the degenerate oligonucleotides of Table 27.

| Name | Sequence | Length | SEQ ID NO |
|---|---|---|---|
| PDH_3710 | IYDYVWGSYAY | 11 | 8331 |
| PDH_3711 | NYDYVWGSYAY | 11 | 8332 |
| PDH_3712 | NYDYVWGSYAS | 11 | 8333 |
| PDH_3713 | YYDYVWGSYAF | 11 | 8334 |
| PDH_3714 | DYDYVWGSYAF | 11 | 8335 |
| PDH_3715 | SYDYVWGSYAY | 11 | 8336 |
| PDH_3716 | DYDYVWGSYAS | 11 | 8337 |
| PDH_3717 | DYDYVWGSYAY | 11 | 8338 |
| PDH_3718 | FYDYVWGSYAS | 11 | 8339 |
| PDH_3719 | NYDYVWGSYAF | 11 | 8340 |
| PDH_3720 | YYDYVWGSYAS | 11 | 8341 |
| PDH_3721 | FYDYVWGSYAY | 11 | 8342 |
| PDH_3722 | SYDYVWGSYAS | 11 | 8343 |
| PDH_3723 | PYDYVWGSYAF | 11 | 8344 |
| PDH_3724 | TYDYVWGSYAY | 11 | 8345 |
| PDH_3725 | VYDYVWGSYAY | 11 | 8346 |
| PDH_3726 | SYDYVWGSYAF | 11 | 8347 |
| PDH_3727 | FYDYVWGSYAF | 11 | 8348 |
| PDH_3728 | HYDYVWGSYAS | 11 | 8349 |
| PDH_3729 | VYDYVWGSYAS | 11 | 8350 |
| PDH_3730 | VYDYVWGSYAF | 11 | 8351 |
| PDH_3731 | YYDYVWGSYAY | 11 | 4071 |
| PDH_3732 | AYDYVWGSYAY | 11 | 8352 |
| PDH_3733 | LYDYVWGSYAS | 11 | 8353 |
| PDH_3734 | TYDYVWGSYAF | 11 | 8354 |
| PDH_3735 | AYDYVWGSYAF | 11 | 8355 |
| PDH_3736 | HYDYVWGSYAY | 11 | 8356 |
| PDH_3737 | TYDYVWGSYAS | 11 | 8357 |
| PDH_3738 | LYDYVWGSYAF | 11 | 8358 |
| PDH_3739 | PYDYVWGSYAY | 11 | 8359 |
| PDH_3740 | PYDYVWGSYAS | 11 | 8360 |
| PDH_3741 | HYDYVWGSYAF | 11 | 8361 |
| PDH_3742 | LYDYVWGSYAY | 11 | 8362 |
| PDH_3743 | IYDYVWGSYAF | 11 | 8363 |
| PDH_3744 | NYDYVWGSYAT | 12 | 8364 |
| PDH_3745 | NYDYVWGSYAYI | 12 | 8365 |
| PDH_3746 | IYDYVWGSYAYI | 12 | 8366 |
| PDH_3747 | YYDYVWGSYAYK | 12 | 8367 |
| PDH_3748 | NYDYVWGSYAYK | 12 | 8368 |
| PDH_3749 | YYDYVWGSYAYT | 12 | 4070 |
| PDH_3750 | PYDYVWGSYAYT | 12 | 8369 |
| PDH_3751 | DYDYVWGSYAYI | 12 | 8370 |
| PDH_3752 | PYDYVWGSYAYK | 12 | 8371 |
| PDH_3753 | FYDYVWGSYAYI | 12 | 8372 |
| PDH_3754 | VYDYVWGSYAYT | 12 | 8373 |
| PDH_3755 | DYDYVWGSYAYK | 12 | 8374 |
| PDH_3756 | IYDYVWGSYAYT | 12 | 8375 |
| PDH_3757 | IYDYVWGSYAYK | 12 | 8376 |
| PDH_3758 | LYDYVWGSYAYI | 12 | 8377 |
| PDH_3759 | HYDYVWGSYAYK | 12 | 8378 |
| PDH_3760 | TYDYVWGSYAYI | 12 | 8379 |
| PDH_3761 | HYDYVWGSYAYT | 12 | 8380 |
| PDH_3762 | AYDYVWGSYAYT | 12 | 8381 |
| PDH_3763 | AYDYVWGSYAYK | 12 | 8382 |
| PDH_3764 | AYDYVWGSYAYI | 12 | 8383 |
| PDH_3765 | TYDYVWGSYAYK | 12 | 8384 |
| PDH_3766 | DYDYVWGSYAYT | 12 | 8385 |
| PDH_3767 | VYDYVWGSYAYK | 12 | 8386 |
| PDH_3768 | TYDYVWGSYAYT | 12 | 8387 |
| PDH_3769 | FYDYVWGSYAYK | 12 | 8388 |
| PDH_3770 | LYDYVWGSYAYK | 12 | 8389 |
| PDH_3771 | VYDYVWGSYAYI | 12 | 8390 |
| PDH_3772 | LYDYVWGSYAYT | 12 | 8391 |
| PDH_3773 | PYDYVWGSYAYI | 12 | 8392 |
| PDH_3774 | FYDYVWGSYAYT | 12 | 8393 |
| PDH_3775 | YYDYVWGSYAYI | 12 | 8394 |
| PDH_3776 | SYDYVWGSYAYI | 12 | 8395 |
| PDH_3777 | HYDYVWGSYAYI | 12 | 8396 |
| PDH_3778 | SYDYVWGSYAYT | 12 | 8397 |
| PDH_3779 | SYDYVWGSYAYK | 12 | 8398 |

TABLE 29

Theoretical segment pool of oligonucleotide sequences encoding N2 segments of Example 14.

| Name | Degenerate Oligo | Peptide Length | | SEQ ID NO |
|---|---|---|---|---|
| N2_000 | | 0 | Not degenerate | n/a |
| N2_001 | GCT | 1 | Not degenerate | n/a |
| N2_002 | GAT | 1 | Not degenerate | n/a |
| N2_003 | GAG | 1 | Not degenerate | n/a |
| N2_004 | TTT | 1 | Not degenerate | n/a |
| N2_005 | GGC | 1 | Not degenerate | n/a |
| N2_006 | CAT | 1 | Not degenerate | n/a |
| N2_007 | ATC | 1 | Not degenerate | n/a |
| N2_008 | AAA | 1 | Not degenerate | n/a |
| N2_009 | TTG | 1 | Not degenerate | n/a |
| N2_010 | ATG | 1 | Not degenerate | n/a |
| N2_011 | CCT | 1 | Not degenerate | n/a |
| N2_012 | CAA | 1 | Not degenerate | n/a |
| N2_013 | AGG | 1 | Not degenerate | n/a |
| N2_014 | TCA | 1 | Not degenerate | n/a |
| N2_015 | ACC | 1 | Not degenerate | n/a |
| N2_016 | GTT | 1 | Not degenerate | n/a |
| N2_017 | TGG | 1 | Not degenerate | n/a |
| N2_018 | TAC | 1 | Not degenerate | n/a |
| N2_019 | GMCKHT | 2 | | n/a |
| N2_020 | GMCSVT | 2 | | n/a |
| N2_021 | GMCSHT | 2 | | n/a |
| N2_022 | GMCSVG | 2 | | n/a |
| N2_023 | GMTDYT | 2 | | n/a |
| N2_024 | KHCGAS | 2 | | n/a |
| N2_025 | KHCGRC | 2 | | n/a |
| N2_026 | KHCGWG | 2 | | n/a |
| N2_027 | KHTTTM | 2 | | n/a |
| N2_028 | KHTTYC | 2 | | n/a |
| N2_029 | KHTTWC | 2 | | n/a |
| N2_030 | KHCRGA | 2 | | n/a |
| N2_031 | KHCKGG | 2 | | n/a |
| N2_032 | KHCCWC | 2 | | n/a |
| N2_033 | KHCCMT | 2 | | n/a |
| N2_034 | KHCMCA | 2 | | n/a |
| N2_035 | GVCSWG | 2 | | n/a |
| N2_036 | GVCMKC | 2 | | n/a |
| N2_037 | GVCWSG | 2 | | n/a |
| N2_038 | SVCYAC | 2 | | n/a |
| N2_039 | GNAAHA | 2 | | n/a |
| N2_040 | BYCSAG | 2 | | n/a |
| N2_041 | RBAAWA | 2 | | n/a |
| N2_042 | RBAAYA | 2 | | n/a |
| N2_043 | SBAMAA | 2 | | n/a |
| N2_044 | VSCMAA | 2 | | n/a |
| N2_045 | GRARVG | 2 | | n/a |
| N2_046 | GRADYT | 2 | | n/a |
| N2_047 | GRABYT | 2 | | n/a |
| N2_048 | GRAKBG | 2 | | n/a |
| N2_049 | RDAGMT | 2 | | n/a |
| N2_050 | RDAGAK | 2 | | n/a |
| N2_051 | RDAGRT | 2 | | n/a |
| N2_052 | RDAGWG | 2 | | n/a |
| N2_053 | RDARGG | 2 | | n/a |
| N2_054 | RDACYA | 2 | | n/a |
| N2_055 | SDACSA | 2 | | n/a |
| N2_056 | VWACYA | 2 | | n/a |
| N2_057 | VWATYA | 2 | | n/a |
| N2_058 | VWAASA | 2 | | n/a |
| N2_059 | YHCGMC | 2 | | n/a |
| N2_060 | YHCGMG | 2 | | n/a |
| N2_061 | YHCGST | 2 | | n/a |
| N2_062 | YHCSCG | 2 | | n/a |
| N2_063 | YHCKCG | 2 | | n/a |
| N2_064 | YHCSAC | 2 | | n/a |
| N2_065 | YHCKAC | 2 | | n/a |
| N2_066 | YHCRGA | 2 | | n/a |
| N2_067 | YHCCWC | 2 | | n/a |
| N2_068 | YHCMCA | 2 | | n/a |
| N2_069 | WTCYHT | 2 | | n/a |
| N2_070 | HYCGWG | 2 | | n/a |
| N2_071 | HYCTTM | 2 | | n/a |
| N2_072 | HYCAGM | 2 | | n/a |
| N2_073 | HYCTMC | 2 | | n/a |

TABLE 29-continued

Theoretical segment pool of oligonucleotide sequences encoding N2 segments of Example 14.

| Name | Degenerate Oligo | Peptide Length | SEQ ID N

TABLE 30

Theoretical segment pool of unique N2 polypeptide segments encoded by the oligonucleotides of Table 29.

| Name | Sequence | Length | SEQ ID NO |
|---|---|---|---|
| PN2_000 |  | 0 | #N/A |
| PN2_001 | A | 1 | #N/A |
| PN2_002 | D | 1 | #N/A |
| PN2_003 | E | 1 | #N/A |
| PN2_004 | F | 1 | #N/A |
| PN2_005 | G | 1 | #N/A |
| PN2_006 | H | 1 | #N/A |
| PN2_007 | I | 1 | #N/A |
| PN2_008 | K | 1 | #N/A |
| PN2_009 | L | 1 | #N/A |
|

TABLE 30-continued

Theoretical segment pool of unique N2 polypeptide segments encoded by the oligonucleotides of Table 29.

| Name | Sequence | Length | SE

TABLE 30-continued

Theoretical segment pool of unique N2 polypeptide segments encoded by the oligonucleotides of Table 29.

| Name | Sequence | Length | SEQ ID NO |
|---|---|---|---|
| PN2_148 | KG | 2 | #N/A |
| PN2_149 | KE | 2 | #N/A |
| PN2_150 | KD | 2 | #N/A |
| PN2_151 | KI | 2 | #N/A |
| PN2_152 | KL | 2 | #N/A |
| PN2_153 | KS | 2 | #N/A |
| PN2_154 | KR | 2 | #N/A |
| PN2_155 | KP | 2 | #N/A |
| PN2_156 | KV | 2 | #N/A |
| PN2_157 | KT | 2 | #N/A |
| PN2_158 | DK | 2 | #N/A |
| PN2_159 | DH | 2 | #N/A |
| PN2_160 | DI | 2 | #N/A |
| PN2_161 | DF | 2 | #N/A |
| PN2_162 | DG | 2 | #N/A |
| PN2_163 | DD | 2 | #N/A |
| PN2_164 | DE | 2 | #N/A |
| PN2_165 | DA | 2 | #N/A |
| PN2_166 | DY | 2 | #N/A |
| PN2_167 | DV | 2 | #N/A |
| PN2_168 | DW | 2 | #N/A |
| PN2_169 | DT | 2 | #N/A |
| PN2_170 | DR | 2 | #N/A |
| PN2_171 | DS | 2 | #N/A |
| PN2_172 | DP | 2 | #N/A |
| PN2_173 | DQ | 2 | #N/A |
| PN2_174 | QQ | 2 | #N/A |
| PN2_175 | QP | 2 | #N/A |
| PN2_176 | QS | 2 | #N/A |
| PN2_177 | QR | 2 | #N/A |
| PN2_178 | QT | 2 | #N/A |
| PN2_179 | QW | 2 | #N/A |
| PN2_180 | QA | 2 | #N/A |
| PN2_181 | QE | 2 | #N/A |
| PN2_182 | QD | 2 | #N/A |
| PN2_183 | QG | 2 | #N/A |
| PN2_184 | QF | 2 | #N/A |
| PN2_185 | QL | 2 | #N/A |
| PN2_186 | WG | 2 | #N/A |
| PN2_187 | WF | 2 | #N/A |
| PN2_188 | WE | 2 | #N/A |
| PN2_189 | WD | 2 | #N/A |
| PN2_190 | WA | 2 | #N/A |
| PN2_191 | WL | 2 | #N/A |
| PN2_192 | WI | 2 | #N/A |
| PN2_193 | WH | 2 | #N/A |
| PN2_194 | WV | 2 | #N/A |
| PN2_195 | WT | 2 | #N/A |
| PN2_196 | WS | 2 | #N/A |
| PN2_197 | WR | 2 | #N/A |
| PN2_198 | WQ | 2 | #N/A |
| PN2_199 | WP | 2 | #N/A |
| PN2_200 | WY | 2 | #N/A |
| PN2_201 | PR | 2 | #N/A |
| PN2_202 | PS | 2 | #N/A |
| PN2_203 | PP | 2 | #N/A |
| PN2_204 | PQ | 2 | #N/A |
| PN2_205 | PV | 2 | #N/A |
| PN2_206 | PW | 2 | #N/A |
| PN2_207 | PT | 2 | #N/A |
| PN2_208 | PY | 2 | #N/A |
| PN2_209 | PA | 2 | #N/A |
| PN2_210 | PF | 2 | #N/A |
| PN2_211 | PG | 2 | #N/A |
| PN2_212 | PD | 2 | #N/A |
| PN2_213 | PE | 2 | #N/A |
| PN2_214 | PK | 2 | #N/A |
| PN2_215 | PH | 2 | #N/A |
| PN2_216 | PI | 2 | #N/A |
| PN2_217 | PL | 2 | #N/A |
| PN2_218 | PM | 2 | #N/A |
| PN2_219 | DL | 2 | #N/A |
| PN2_220 | IY | 2 | #N/A |
| PN2_221 | VA | 2 | #N/A |

TABLE 30-continued

Theoretical segment pool of unique N2 polypeptide segments encoded by the oligonucleotides of Table 29.

| Name | S

TABLE 30-continued

Theoretical segment pool of unique N2 polypeptide segments encoded by the oligonucleotides of Table 29.

| Name | Sequence | Length | SEQ ID NO |
|---|---|---|---|
| PN2_296 | AV | 2 | #N/A |
| PN2_297 | AY | 2 | #N/A |
| PN2_298 | AGM | 3 | #N/A |
| PN2_299 | AGL | 3 | #N/A |
| PN2_300 | AGH | 3 | #N/A |
| PN2_301 | AGG | 3 | #N/A |
| PN2_302 | AGE | 3 | #N/A |
| PN2_303 | AGA | 3 | #N/A |
| PN2_304 | TQG | 3 | #N/A |
| PN2_305 | AGY | 3 | #N/A |
| PN2_306 | AGW | 3 | #N/A |
| PN2_307 | AGV | 3 | #N/A |
| PN2_308 | AGS | 3 | #N/A |
| PN2_309 | AGR | 3 | #N/A |
| PN2_310 | SPY | 3 | #N/A |
| PN2_311 | SPP | 3 | #N/A |
| PN2_312 | TAG | 3 | #N/A |
| PN2_313 | SPL | 3 | #N/A |
| PN2_314 | TAA | 3 | #N/A |
| PN2_315 | SPG | 3 | #N/A |
| PN2_316 | VAA | 3 | #N/A |
| PN2_317 | VAG | 3 | #N/A |
| PN2_318 | NPL | 3 | #N/A |
| PN2_319 | PAA | 3 | #N/A |
| PN2_320 | NPG | 3 | #N/A |
| PN2_321 | LAG | 3 | #N/A |
| PN2_322 | LAA | 3 | #N/A |
| PN2_323 | NPY | 3 | #N/A |
| PN2_324 | ALG | 3 | #N/A |
| PN2_325 | RLG | 3 | #N/A |
| PN2_326 | TSG | 3 | #N/A |
| PN2_327 | DTA | 3 | #N/A |
| PN2_328 | PAG | 3 | #N/A |
| PN2_329 | QGG | 3 | #N/A |
| PN2_330 | DLG | 3 | #N/A |
| PN2_331 | DTQ | 3 | #N/A |
| PN2_332 | LSG | 3 | #N/A |
| PN2_333 | LSE | 3 | #N/A |
| PN2_334 | PGR | 3 | #N/A |
| PN2_335 | VLG | 3 | #N/A |
| PN2_336 | LSW | 3 | #N/A |
| PN2_337 | AFE | 3 | #N/A |
| PN2_338 | TTG | 3 | #N/A |
| PN2_339 | FTQ | 3 | #N/A |
| PN2_340 | IGV | 3 | #N/A |
| PN2_341 | NFE | 3 | #N/A |
| PN2_342 | IGS | 3 | #N/A |
| PN2_343 | IGR | 3 | #N/A |
| PN2_344 | PGS | 3 | #N/A |
| PN2_345 | IGG | 3 | #N/A |
| PN2_346 | GRG | 3 | #N/A |
| PN2_347 | IGA | 3 | #N/A |
| PN2_348 | DSG | 3 | #N/A |
| PN2_349 | IGL | 3 | #N/A |
| PN2_350 | HLG | 3 | #N/A |
| PN2_351 | HPP | 3 | #N/A |
| PN2_352 | AKQ | 3 | #N/A |
| PN2_353 | GLG | 3 | #N/A |
| PN2_354 | LFE | 3 | #N/A |
| PN2_355 | GGV | 3 | #N/A |
| PN2_356 | GGS | 3 | #N/A |
| PN2_357 | GGR | 3 | #N/A |
| PN2_358 | GGG | 3 | #N/

TABLE 30-continued

Theoretical segment pool of unique N2 polypeptide segments encoded by the oligonucleotides of Table 29.

| Name | Sequence | Length | SEQ ID NO |
|---|---|---|---|
| PN2_370 | HTA | 3 | #N/A |
| PN2_371 | DPP | 3 | #N/A |
| PN2_372 | PGG | 3 | #N/A |
| PN2_373 | VPP | 3 | #N/A |
| PN2_374 | PGA | 3 | #N/A |
| PN2_375 | VPY | 3 | #N/A |
| PN2_376 | PGV | 3 | #N/A |
| PN2_377 | VPL | 3 | #N/A |
| PN2_378 | STG | 3 | #N/A |
| PN2_379 | STA | 3 | #N/A |
| PN2_380 | HGV | 3 | #N/A |

TABLE 30-continued

Theoretical segment pool of unique N2 polypeptide segments encoded by the oligonucleotides of Table 29.

| Name | Sequence | Length | SEQ ID NO |
|---|---|---|---|
| PN2_444 | HPL | 3 | #N/A |
| PN2_445 | ISW | 3 | #N/A |
| PN2_446 | ATQ | 3 | #N/A |
| PN2_447 | ISG | 3 | #N/A |
| PN2_448 | ISE | 3 | #N/A |
| PN2_449 | DGR | 3 | #N/A |
| PN2_450 | ASW | 3 | #N/A |
| PN2_451 | DGG | 3 | #N/A |
| PN2_452 | DGE | 3 | #N/A |
| PN2_453 | HPG | 3 | #N/A |
| PN2_454 | DGH | 3 | #N/A |
| PN2_455 | DGL | 3 | #N/A |
| PN2_456 | DGM | 3 | #N/A |
| PN2_457 | LKQ | 3 | #N/A |
| PN2_458 | DGV | 3 | #N/A |
| PN2_459 | DGW | 3 | #N/A |
| PN2_460 | PVG | 3 | #N/A |
| PN2_461 | ASG | 3 | #N/A |
| PN2_462 | IRG | 3 | #N/A |
| PN2_463 | VTA | 3 | #N/A |
| PN2_464 | TSE | 3 | #N/A |
| PN2_465 | FRG | 3 | #N/A |
| PN2_466 | ASE | 3 | #N/A |
| PN2_467 | VTG | 3 | #N/A |
| PN2_468 | GTG | 3 | #N/A |
| PN2_469 | LGW | 3 | #N/A |
| PN2_470 | VTQ | 3 | #N/A |
| PN2_471 | TLG | 3 | #N/A |
| PN2_472 | YAA | 3 | #N/A |
| PN2_473 | DGY | 3 | #N/A |
| PN2_474 | ITG | 3 | #N/A |
| PN2_475 | HVG | 3 | #N/A |
| PN2_476 | RPP | 3 | #N/A |
| PN2_477 | AAG | 3 | #N/A |
| PN2_478 | RSG | 3 | #N/A |
| PN2_479 | AAA | 3 | #N/A |
| PN2_480 | TGR | 3 | #N/A |
| PN2_481 | TGS | 3 | #N/A |
| PN2_482 | TGV | 3 | #N/A |
| PN2_483 | RPY | 3 | #N/A |
| PN2_484 | TGA | 3 | #N/A |
| PN2_485 | TGG | 3 | #N/A |
| PN2_486 | RPG | 3 | #N/A |
| PN2_487 | RPL | 3 | #N/A |
| PN2_488 | TGL | 3 | #N/A |
| PN2_489 | FKQ | 3 | #N/A |
| PN2_490 | FKR | 3 | #N/A |
| PN2_491 | SLG | 3 | #N/A |
| PN2_492 | LGM | 3 | #N/A |
| PN2_493 | LGA | 3 | #

TABLE 30-continued

Theoretical segment pool of unique N2 polypeptide segments encoded by the oligonucleotides of Table 29.

| Name | Sequence | Length | SEQ ID NO |
|---|---|---|---|
| PN2_518 | RGS | 3 | #N/A |
| PN2_519 | SKQ | 3 | #N/A |
| PN2_520 | RGV | 3 | #N/A |
| PN2_521 | SKR | 3 | #N/A |
| PN2_522 | RGA | 3 | #N/A |
| PN2_523 | RGG | 3 | #N/A |
| PN2_524 | RGL | 3 | #N/A |
| PN2_525 | VGL | 3 | #N/A |
| PN2_526 | VGM | 3 | #N/A |
| PN2_527 | VGH | 3 | #N/A |
| PN2_528 | FGY | 3 | #N/A |
| PN2_529 | VGE | 3 | #N/A |
| PN2_530 | VGG | 3 | #N/A |
| PN2_531 | VGA | 3 | #N/A |
| PN2_532 | YKR | 3 | #N/A |
| PN2_533 | YKQ | 3 | #N/A |
| PN2_534 | VGY | 3 | #N/A |
| PN2_535 | VGV | 3 | #N/A |
| PN2_536 | VGW | 3 | #N/A |
| PN2_537 | VGR | 3 | #N/A |
| PN2_538 | VGS | 3 | #N/A |
| PN2_539 | FTA | 3 | #N/A |
| PN2_540 | PSG | 3 | #N/A |
| PN2_541 | PSE | 3 | #N/A |
| PN2_542 | NVG | 3 | #N/A |
| PN2_543 | FGV | 3 | #N/A |
| PN2_544 | FGL | 3 | #N/A |
| PN2_545 | ILG | 3 | #N/A |
|

TABLE 30-continued

Theoretical segment pool of unique N2 polypeptide segments encoded by the oligonucleotides of Table 29.

| Name | Sequence | Length | SEQ ID NO |
|---|---|---|---|
| PN2_592 | PGE | 3 | #N/A |
| PN2_593 | PTA | 3 | #N/A |
| PN2_594 | LLG | 3 | #N/A |
| PN2_595 | PTQ | 3 | #N/A |
| PN2_596 | TRG | 3 | #N/A |
| PN2_597 | GVG | 3 | #N/A |
| PN2_598 | IVG | 3 | #N/A |
| PN2_599 | LRG | 3 | #N/A |
| PN2_600 | HTQ | 3 | #N/A |
| PN2_601 | AVG | 3 | #N/A |
| PN2_602 | IPY | 3 | #N/A |
| PN2_603 | YQG | 3 | #N/A |
| PN2_604 | HFE | 3 | #N/A |
| PN2_605 | RRG | 3 | #N/A |
| PN2_606 | LGH | 3 | #N/A |
| PN2_607 | LGL | 3 | #N/A |
| PN2_608 | TSW | 3 | #N/A |
| PN2_609 | TKQ | 3 | #N/A |
| PN2_610 | IQG | 3 | #N/A |
| PN2_611 | HQG | 3 | #N/A |
| PN2_612 | SGY | 3 | #N/A |
| PN2_613 | DAG | 3 | #N/A |
| PN2_614 | DAA | 3 | #N/A |
| PN2_615 | SGR | 3 | #N/A |
| PN2_616 | SGV | 3 | #N/A |
| PN2_617 | SGH | 3 | #N/A |
| PN2_618 | SGM | 3 | #N/A |
| PN2_619 | SGA | 3 | #N/A |
| PN2_620 | SGE | 3 | #N/A |
| PN2_621 | SGG | 3 | #N/A |
| PN2_622 | YTQ | 3 | #N/A |
| PN2_623 | YGG | 3 | #N/A |
| PN2_624 | YGE | 3 | #N/A |
| PN2_625 | PFE | 3 | #N/A |
| PN2_626 | VSW | 3 | #N/A |
| PN2_627 | YGM | 3 | #N/A |
| PN2_628 | YGL | 3 | #N/A |
| PN2_629 | YGH | 3 | #N/A |
| PN2_630 | YGW | 3 | #N/A |
| PN2_631 | YGV | 3 | #N/A |
| PN2_632 | NKR | 3 | #N/A |
| PN2_633 | VSE | 3 | #N/A |
| PN2_634 | KGG | 3 | #N/A |
| PN2_635 | VSG | 3 | #N/A |
| PN2_636 | YGY | 3 | #N/A |
| PN2_637 | RPGY | 4 | 8409 |
| PN2_638 | SAGY | 4 | 6277 |
| PN2_639 | PSGY | 4 | 6268 |
| PN2_640 | RFGY | 4 | 8410 |
| PN2_641 | RLGY | 4 | 8411 |
| PN2_642 | PYGY | 4 | 6281 |
| PN2_643 | GREY | 4 | 8412 |
| PN2_644 | GRKY | 4 | 8413 |
| PN2_645 | GHGW | 4 | 8414 |
| PN2_646 | RVGY | 4 | 8415 |
| PN2_647 | GLGL | 4 | 8416 |
| PN2_648 | GHGY | 4 | 8417 |
| PN2_649 | RDGY | 4 | 4410 |
| PN2_650 | RRVY | 4 | 8418 |
| PN2_651 | GLGW | 4 | 8419 |
| PN2_652 | GHGL | 4 | 8420 |
| PN2_653 | GLGY | 4 | 8421 |
| PN2_654 | PVGY | 4 | 8422 |
| PN2_655 | GPGY | 4 | 8423 |
| PN2_656 | GPGW | 4 | 8424 |
| PN2_657 | PDGY | 4 | 5829 |
| PN2_658 | GPGL | 4 | 8425 |
| PN2_659 | GVTA | 4 | 8426 |
| PN2_660 | GRLY | 4 | 8427 |
| PN2_661 | RRAY | 4 | 8428 |
| PN2_662 | GHTQ | 4 | 8429 |
| PN2_663 | GVGL | 4 | 8430 |
| PN2_664 | SYGY | 4 | 4434 |
| PN2_665 | RRQY | 4 | 8431 |

TABLE 30-continued

Theoretical segment pool of unique N2 polypeptide segments encoded by the oligonucleotides of Table 29.

| Name | Sequence | Length | SEQ ID NO |
|---|---|---|---|
| PN2_666 | GATQ | 4 | 8432 |
| PN2_667 | PFGY | 4 | 8433 |
| PN2_668 | GVGY | 4 | 8434 |
| PN2_669 | GVGW | 4 | 8435 |
| PN2_670 | RAGY | 4 | 6278 |
| PN2_671 | GATA | 4 | 8436 |
| PN2_672 | RYGY | 4 | 6262 |
| PN2_673 | GRAY | 4 | 8437 |
| PN2_674 | GRMY | 4 | 8438 |
| PN2_675 | GRTY | 4 | 8439 |
| PN2_676 | PPGY | 4 | 8440 |
| PN2_677 | RRPY | 4 | 8441 |
| PN2_678 | RHGY | 4 | 8442 |
| PN2_679 | GDGY | 4 | 5813 |
| PN2_680 | SVGY | 4 | 8443 |
| PN2_681 | GVTQ | 4 | 8444 |
| PN2_682 | GDGW | 4 | 8445 |
| PN2_683 | GRQY | 4 | 8446 |
| PN2_684 | GDGL | 4 | 8447 |
| PN2_685 | SHGY | 4 | 8448 |
| PN2_686 | GSGY | 4 | 6284 |
| PN2_687 | GFGY | 4 | 8449 |
| PN2_688 | GFGW | 4 | 8450 |
| PN2_689 | GSGW | 4 | 8451 |
| PN2_690 | GFGL | 4 | 8452 |
| PN2_691 | GSGL | 4 | 8453 |
| PN2_692 | RRLY | 4 | 8454 |
| PN2_693 | GFTA | 4 | 8455 |
| PN2_694 | PLGY | 4 | 8456 |
| PN2_695 | GYTQ | 4 | 8457 |
| PN2_696 | GLTQ | 4 | 8458 |
| PN2_697 | GHTA | 4 | 8459 |
| PN2_698 | PHGY | 4 | 8460 |
| PN2_699 | GFTQ | 4 | 8461 |
| PN2_700 | GRVY | 4 | 8462 |
| PN2_701 | GYTA | 4 | 8463 |
| PN2_702 | GLTA | 4 | 8464 |
| PN2_703 | PAGY | 4 | 6276 |
| PN2_704 | RRKY | 4 | 8465 |
| PN2_705 | SSGY | 4 | 4186 |
| PN2_706 | GPTQ | 4 | 8466 |
| PN2_707 | SDGY | 4 | 5805 |
| PN2_708 | GPTA | 4 | 8467 |
| PN2_709 | GDTQ | 4 | 8468 |
| PN2_710 | GAGW | 4 | 8469 |
| PN2_711 | GAGY | 4 | 6270 |
| PN2_712 | GDTA | 4 | 8470 |
| PN2_713 | SFGY | 4 | 8471 |
| PN2_714 | GAGL | 4 | 8472 |
| PN2_715 | GSTQ | 4 | 8473 |
| PN2_716 | GRPY | 4 | 8474 |
| PN2_717 | SLGY | 4 | 8475 |
| PN2_718 | GSTA | 4 | 8476 |
| PN2_719 | GYGL | 4 | 8477 |
| PN2_720 | RSGY | 4 | 6269 |
| PN2_721 | RREY | 4 | 8478 |
| PN2_722 | SPGY | 4 | 8479 |
| PN2_723 | GYGY | 4 | 6260 |
| PN2_724 | RRTY | 4 | 8480 |
| PN2_725 | GYGW | 4 | 8481 |
| PN2_726 | RRMY | 4 | 8482 |

TABLE 31

Theoretical segment pool of oligonucleotides encoding JH segments of Example 15.

| Name | Degenerate Oligo | Peptide Length | Degenerate | SEQ ID NO |
|---|---|---|---|---|
| JH4_001 | TGGGGACAGGGTACATTGGTCACCGTCTCCTCA | | 0 | 8483 |
| JH1_002 | CATTGGGGACAGGGTACATTGGTCACCGTCTCCTCA | | 1 | 8484 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH1_003 | ATTTGGGGACAGGGTACATTGGTCACCGTCTCCTCA | 1 | | 8485 |
| JH1_004 | TACTGGGGACAGGGTACATTGGTCACCGTCTCCTCA | 1 | | 8486 |
| JH1_005 | CCATGGGGACAGGGTACATTGGTCACCGTCTCCTCA | 1 | | 8487 |
| JH1_006 | GTCTGGGGACAGGGTACATTGGTCACCGTCTCCTCA | 1 | | 8488 |
| JH1_007 | GATTGGGGACAGGGTACATTGGTCACCGTCTCCTCA | 1 | | 8489 |
| JH1_008 | TTCTGGGGACAGGGTACATTGGTCACCGTCTCCTCA | 1 | | 8490 |
| JH1_009 | AATTGGGGACAGGGTACATTGGTCACCGTCTCCTCA | 1 | | 8491 |
| JH1_010 | AGTTGGGGACAGGGTACATTGGTCACCGTCTCCTCA | 1 | | 8492 |
| JH1_011 | ACTTGGGGACAGGGTACATTGGTCACCGTCTCCTCA | 1 | | 8493 |
| JH1_200 | GCATGGGGACAGGGTACATTGGTCACCGTCTCCTCA | 1 | | 8494 |
| JH4_013 | GATTACTGGGGACAGGGTACATTGGTCACCGTCTCCTCA | 2 | | 8495 |
| JH4_016 | GCTTACTGGGGACAGGGTACATTGGTCACCGTCTCCTCA | 2 | | 8496 |
| JH4_017 | TTCTACTGGGGACAGGGTACATTGGTCACCGTCTCCTCA | 2 | | 8497 |
| JH4_018 | GGCTATTGGGGACAGGGTACATTGGTCACCGTCTCCTCA | 2 | | 8498 |
| JH4_019 | CATTACTGGGGACAGGGTACATTGGTCACCGTCTCCTCA | 2 | | 8499 |
| JH4_023 | AGTTACTGGGGACAGGGTACATTGGTCACCGTCTCCTCA | 2 | | 8500 |
| JH4_024 | GTTTATTGGGGACAGGGTACATTGGTCACCGTCTCCTCA | 2 | | 8501 |
| JH4_025 | TACTATTGGGGACAGGGTACATTGGTCACCGTCTCCTCA | 2 | | 8502 |
| JH4_022 | CSATACTGGGGACAGGGTACATTGGTCACCGTCTCCTCA | 2 | YES | 8503 |
| JH3_012 | RACATATGGGGTCAGGGTACAATGGTCACCGTCTCCTCA | 2 | YES | 8504 |
| JH5_014 | RACCCATGGGGACAGGGTACATTGGTCACCGTCTCCTCA | 2 | YES | 8505 |
| JH3_015 | RACGTATGGGGTCAGGGTACAATGGTCACCGTCTCCTCA | 2 | YES | 8506 |
| JH4_021 | AMCTACTGGGGACAGGGTACATTGGTCACCGTCTCCTCA | 2 | YES | 8507 |
| JH4_020 | MTATACTGGGGACAGGGTACATTGGTCACCGTCTCCTCA | 2 | YES | 8508 |
| JH4_029 | TTCGATTATTGGGGACAGGGTACATTGGTCACCGTCTCCTCA | 3 | | 8509 |
| JH4_030 | ATTGACTACTGGGGACAGGGTACATTGGTCACCGTCTCCTCA | 3 | | 8510 |
| JH4_031 | GTGGACTACTGGGGACAGGGTACATTGGTCACCGTCTCCTCA | 3 | | 8511 |
| JH4_032 | TTAGATTACTGGGGACAGGGTACATTGGTCACCGTCTCCTCA | 3 | | 8512 |
| JH4_033 | TCCGATTATTGGGGACAGGGTACATTGGTCACCGTCTCCTCA | 3 | | 8513 |
| JH4_034 | CACGATTACTGGGGACAGGGTACATTGGTCACCGTCTCCTCA | 3 | | 8514 |
| JH4_035 | AGAGACTACTGGGGACAGGGTACATTGGTCACCGTCTCCTCA | 3 | | 8515 |
| JH4_036 | CCAGATTACTGGGGACAGGGTACATTGGTCACCGTCTCCTCA | 3 | | 8516 |
| JH4_037 | AACGATTACTGGGGACAGGGTACATTGGTCACCGTCTCCTCA | 3 | | 8517 |
| JH4_038 | ACTGATTACTGGGGACAGGGTACATTGGTCACCGTCTCCTCA | 3 | | 8518 |
| JH4_039 | GATGATTATTGGGGACAGGGTACATTGGTCACCGTCTCCTCA | 3 | | 8519 |
| JH4_040 | GGTGATTATTGGGGACAGGGTACATTGGTCACCGTCTCCTCA | 3 | | 8520 |
| JH4_041 | GCAGACTACTGGGGACAGGGTACATTGGTCACCGTCTCCTCA | 3 | | 8521 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH4_042 | TACGATTATTGGGGACAGGGTACATTGGTCACCGTCTCCTCA | 3 | | 8522 |
| JH5_043 | TTCGATCCCTGGGGACAGGGTACATTGGTCACCGTCTCCTCA | 3 | | 8523 |
| JH6_044 | ATGGATGTGTGGGGCCAGGGAACAACTGTCACCGTCTCCTCA | 3 | | 8524 |
| JH1_026 | TTMCAACACTGGGGACAGGGTACATTGGTCACCGTCTCCTCA | 3 | YES | 8525 |
| JH3_046 | STAGACGTATGGGGTCAGGGTACAATGGTCACCGTCTCCTCA | 3 | YES | 8526 |
| JH3_028 | TTMGACATATGGGGTCAGGGTACAATGGTCACCGTCTCCTCA | 3 | YES | 8527 |
| JH2_027 | TTMGACCTATGGGGGAGAGGTACCTTGGTCACCGTCTCCTCA | 3 | YES | 8528 |
| JH5_045 | TYAGACCCATGGGGACAGGGTACATTGGTCACCGTCTCCTCA | 3 | YES | 8529 |
| JH3_049 | GCCTTTGATATTTGGGGTCAGGGTACAATGGTCACCGTCTCCTCA | 4 | | 8530 |
| JH4_051 | TACTTTGACTACTGGGGACAGGGTACATTGGTCACCGTCTCCTCA | 4 | | 8531 |
| JH4_052 | AATTTCGACTACTGGGGACAGGGTACATTGGTCACCGTCTCCTCA | 4 | | 8532 |
| JH4_053 | GACTTCGACTATTGGGGACAGGGTACATTGGTCACCGTCTCCTCA | 4 | | 8533 |
| JH4_054 | CATTTCGATTACTGGGGACAGGGTACATTGGTCACCGTCTCCTCA | 4 | | 8534 |
| JH4_055 | TTCTTTGATTATTGGGGACAGGGTACATTGGTCACCGTCTCCTCA | 4 | | 8535 |
| JH4_056 | TCTTTTGATTATTGGGGACAGGGTACATTGGTCACCGTCTCCTCA | 4 | | 8536 |
| JH4_057 | AGATTCGACTACTGGGGACAGGGTACATTGGTCACCGTCTCCTCA | 4 | | 8537 |
| JH4_058 | TTGTTCGACTACTGGGGACAGGGTACATTGGTCACCGTCTCCTCA | 4 | | 8538 |
| JH4_059 | CCCTTCGACTATTGGGGACAGGGTACATTGGTCACCGTCTCCTCA | 4 | | 8539 |
| JH4_060 | ATTTTCGATTATTGGGGACAGGGTACATTGGTCACCGTCTCCTCA | 4 | | 8540 |
| JH4_061 | ACCTTTGATTACTGGGGACAGGGTACATTGGTCACCGTCTCCTCA | 4 | | 8541 |
| JH4_062 | GGATTCGATTACTGGGGACAGGGTACATTGGTCACCGTCTCCTCA | 4 | | 8542 |
| JH4_063 | GTTTTCGATTACTGGGGACAGGGTACATTGGTCACCGTCTCCTCA | 4 | | 8543 |
| JH4_064 | GCTTTTGACTACTGGGGACAGGGTACATTGGTCACCGTCTCCTCA | 4 | | 8544 |
| JH5_065 | TGGTTTGATCCATGGGGACAGGGTACATTGGTCACCGTCTCCTCA | 4 | | 8545 |
| JH6_068 | GGAATGGACGTATGGGGCCAGGGAACAACTGTCACCGTCTCCTCA | 4 | | 8546 |
| JH6_070 | YCAATGGACGTATGGGGCCAGGGAACAACTGTCACCGTCTCCTCA | 4 | YES | 8547 |
| JH6_069 | KACATGGACGTATGGGGCAAGGGTACAACTGTCACCGTCTCCTCA | 4 | YES | 8548 |
| JH3_198 | STATTCGACATATGGGGTCAGGGTACAATGGTCACCGTCTCCTCA | 4 | YES | 8549 |
| JH2_048 | KACTTCGACCTATGGGGGAGAGGTACCTTGGTCACCGTCTCCTCA | 4 | YES | 8550 |
| JH1_047 | KACTTCCAACACTGGGGACAGGGTACATTGGTCACCGTCTCCTCA | 4 | YES | 8551 |
| JH5_067 | GSATTCGACCCATGGGGACAGGGTACATTGGTCACCGTCTCCTCA | 4 | YES | 8552 |
| JH3_050 | YCATTCGACATATGGGGTCAGGGTACAATGGTCACCGTCTCCTCA | 4 | YES | 8553 |
| JH5_066 | AGMTTCGACCCATGGGGACAGGGTACATTGGTCACCGTCTCCTCA | 4 | YES | 8554 |
| JH2_072 | TGGTACTTCGACTTATGGGGGAGAGGTACCTTGGTCACCGTCTCCTCA | 5 | | 8555 |
| JH3_075 | GACGCATTTGATATATGGGGTCAGGGTACAATGGTCACCGTCTCCTCA | 5 | | 8556 |
| JH3_076 | TACGCATTTGATATTTGGGGTCAGGGTACAATGGTCACCGTCTCCTCA | 5 | | 8557 |
| JH3_077 | CACGCATTCGACATCTGGGGTCAGGGTACAATGGTCACCGTCTCCTCA | 5 | | 8558 |
| JH3_078 | TTCGCATTCGATATCTGGGGTCAGGGTACAATGGTCACCGTCTCCTCA | 5 | | 8559 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH3_079 | TCAGCTTTCGACATATGGGGTCAGGGTACAATGGTCACCGTCTCCTCA | 5 | | 8560 |
| JH3_080 | AGAGCCTTCGATATATGGGGTCAGGGTACAATGGTCACCGTCTCCTCA | 5 | | 8561 |
| JH3_081 | TTAGCCTTCGATATCTGGGGTCAGGGTACAATGGTCACCGTCTCCTCA | 5 | | 8562 |
| JH3_082 | GGAGCCTTCGACATATGGGGTCAGGGTACAATGGTCACCGTCTCCTCA | 5 | | 8563 |
| JH4_086 | GACTATTTTGATTACTGGGGACAGGGTACATTGGTCACCGTCTCCTCA | 5 | | 8564 |
| JH4_087 | TATTACTTTGATTACTGGGGACAGGGTACATTGGTCACCGTCTCCTCA | 5 | | 8565 |
| JH4_088 | CACTATTTCGACTATTGGGGACAGGGTACATTGGTCACCGTCTCCTCA | 5 | | 8566 |
| JH4_089 | TTCTATTTTGATTACTGGGGACAGGGTACATTGGTCACCGTCTCCTCA | 5 | | 8567 |
| JH4_090 | AGTTATTTTGACTATTGGGGACAGGGTACATTGGTCACCGTCTCCTCA | 5 | | 8568 |
| JH4_091 | AGATACTTTGATTACTGGGGACAGGGTACATTGGTCACCGTCTCCTCA | 5 | | 8569 |
| JH4_092 | TTATATTTCGACTATTGGGGACAGGGTACATTGGTCACCGTCTCCTCA | 5 | | 8570 |
| JH4_093 | CCCTACTTTGACTATTGGGGACAGGGTACATTGGTCACCGTCTCCTCA | 5 | | 8571 |
| JH4_095 | GGATATTTCGATTATTGGGGACAGGGTACATTGGTCACCGTCTCCTCA | 5 | | 8572 |
| JH4_096 | GTTTACTTTGATTATTGGGGACAGGGTACATTGGTCACCGTCTCCTCA | 5 | | 8573 |
| JH4_097 | GCTTACTTTGATTATTGGGGACAGGGTACATTGGTCACCGTCTCCTCA | 5 | | 8574 |
| JH4_098 | AACTACTTCGATTACTGGGGACAGGGTACATTGGTCACCGTCTCCTCA | 5 | | 8575 |
| JH5_099 | AATTGGTTCGATCCTTGGGGACAGGGTACATTGGTCACCGTCTCCTCA | 5 | | 8576 |
| JH5_100 | GATTGGTTTGATCCATGGGGACAGGGTACATTGGTCACCGTCTCCTCA | 5 | | 8577 |
| JH5_101 | TATTGGTTTGATCCATGGGGACAGGGTACATTGGTCACCGTCTCCTCA | 5 | | 8578 |
| JH5_102 | CACTGGTTCGATCCATGGGGACAGGGTACATTGGTCACCGTCTCCTCA | 5 | | 8579 |
| JH5_103 | TTCTGGTTTGACCCCTGGGGACAGGGTACATTGGTCACCGTCTCCTCA | 5 | | 8580 |
| JH5_104 | TCTTGGTTTGATCCCTGGGGACAGGGTACATTGGTCACCGTCTCCTCA | 5 | | 8581 |
| JH5_105 | AGATGGTTTGATCCTTGGGGACAGGGTACATTGGTCACCGTCTCCTCA | 5 | | 8582 |
| JH5_107 | GGTTGGTTCGATCCCTGGGGACAGGGTACATTGGTCACCGTCTCCTCA | 5 | | 8583 |
| JH5_109 | GCTTGGTTTGATCCATGGGGACAGGGTACATTGGTCACCGTCTCCTCA | 5 | | 8584 |
| JH6_110 | TACGGTATGGACGTTTGGGGCCAGGGAACAACTGTCACCGTCTCCTCA | 5 | | 8585 |
| JH6_112 | GATGGGATGGATGTTTGGGGCCAGGGAACAACTGTCACCGTCTCCTCA | 5 | | 8586 |
| JH3_084 | SCAGCATTCGACATATGGGGTCAGGGTACAATGGTCACCGTCTCCTCA | 5 | YES | 8587 |
| JH5_106 | MCATGGTTCGACCCATGGGGACAGGGTACATTGGTCACCGTCTCCTCA | 5 | YES | 8588 |
| JH2_073 | RGCTACTTCGACCTATGGGGGAGAGGTACCTTGGTCACCGTCTCCTCA | 5 | YES | 8589 |
| JH4_094 | AYATACTTCGACTACTGGGGACAGGGTACATTGGTCACCGTCTCCTCA | 5 | YES | 8590 |
| JH5_108 | RTATGGTTCGACCCATGGGGACAGGGTACATTGGTCACCGTCTCCTCA | 5 | YES | 8591 |
| JH6_113 | CWCGGAATGGACGTATGGGGCCAGGGAACAACTGTCACCGTCTCCTCA | 5 | YES | 8592 |
| JH6_114 | KCAGGAATGGACGTATGGGGCCAGGGAACAACTGTCACCGTCTCCTCA | 5 | YES | 8593 |
| JH3_083 | RTAGCATTCGACATATGGGGTCAGGGTACAATGGTCACCGTCTCCTCA | 5 | YES | 8594 |
| JH1_071 | RAGTACTTCCAACACTGGGGACAGGGTACATTGGTCACCGTCTCCTCA | 5 | YES | 8595 |
| JH3_085 | AMCGCATTCGACATATGGGGTCAGGGTACAATGGTCACCGTCTCCTCA | 5 | YES | 8596 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH2_074 | CKATACTTCGACCTATGGGGGAGAGGTACCTTGGTCACCGTCTCCTCA | 5 | YES | 8597 |
| JH6_111 | KACTACATGGACGTATGGGGCAAGGGTACAACTGTCACCGTCTCCTCA | 5 | YES | 8598 |
| JH2_116 | TACTGGTACTTCGATTTGTGGGGAGAGGTACCTTGGTCACCGTCTCCTCA | 6 | | 8599 |
| JH2_117 | GATTGGTACTTCGATTTATGGGGAGAGGTACCTTGGTCACCGTCTCCTCA | 6 | | 8600 |
| JH5_120 | GATAATTGGTTCGATCCATGGGGACAGGGTACATTGGTCACCGTCTCCTCA | 6 | | 8601 |
| JH5_121 | TATAACTGGTTCGATCCCTGGGGACAGGGTACATTGGTCACCGTCTCCTCA | 6 | | 8602 |
| JH5_122 | CACAATTGGTTCGACCCCTGGGGACAGGGTACATTGGTCACCGTCTCCTCA | 6 | | 8603 |
| JH5_123 | TTCAATTGGTTTGATCCCTGGGGACAGGGTACATTGGTCACCGTCTCCTCA | 6 | | 8604 |
| JH5_124 | AGCAACTGGTTCGACCCATGGGGACAGGGTACATTGGTCACCGTCTCCTCA | 6 | | 8605 |
| JH5_125 | AGAAACTGGTTTGATCCATGGGGACAGGGTACATTGGTCACCGTCTCCTCA | 6 | | 8606 |
| JH5_126 | TTAAATTGGTTCGACCCTTGGGGACAGGGTACATTGGTCACCGTCTCCTCA | 6 | | 8607 |
| JH5_127 | CCCAATTGGTTTGATCCATGGGGACAGGGTACATTGGTCACCGTCTCCTCA | 6 | | 8608 |
| JH5_128 | ATAAATTGGTTCGACCCTTGGGGACAGGGTACATTGGTCACCGTCTCCTCA | 6 | | 8609 |
| JH5_129 | ACTAACTGGTTTGACCCATGGGGACAGGGTACATTGGTCACCGTCTCCTCA | 6 | | 8610 |
| JH5_130 | GGTAACTGGTTTGACCCATGGGGACAGGGTACATTGGTCACCGTCTCCTCA | 6 | | 8611 |
| JH5_131 | GTGAACTGGTTTGATCCCTGGGGACAGGGTACATTGGTCACCGTCTCCTCA | 6 | | 8612 |
| JH5_132 | GCCAACTGGTTCGATCCCTGGGGACAGGGTACATTGGTCACCGTCTCCTCA | 6 | | 8613 |
| JH5_133 | AACAATTGGTTCGACCCATGGGGACAGGGTACATTGGTCACCGTCTCCTCA | 6 | | 8614 |
| JH6_134 | TACTACGGCATGGATGTATGGGGCCAGGGAACAACTGTCACCGTCTCCTCA | 6 | | 8615 |
| JH6_136 | GATTATGGAATGGACGTATGGGGCCAGGGAACAACTGTCACCGTCTCCTCA | 6 | | 8616 |
| JH6_137 | TTCTACGGTATGGATGTCTGGGGCCAGGGAACAACTGTCACCGTCTCCTCA | 6 | | 8617 |
| JH6_138 | CATTACGGAATGGACGTATGGGGCCAGGGAACAACTGTCACCGTCTCCTCA | 6 | | 8618 |
| JH6_139 | TTGTACGGAATGGACGTTTGGGGCCAGGGAACAACTGTCACCGTCTCCTCA | 6 | | 8619 |
| JH6_140 | AACTATGGCATGGATGTGTGGGGCCAGGGAACAACTGTCACCGTCTCCTCA | 6 | | 8620 |
| JH2_118 | CWCTGGTACTTCGACCTATGGGGAGAGGTACCTTGGTCACCGTCTCCTCA | 6 | YES | 8621 |
| JH6_141 | SCATACGGAATGGACGTATGGGGCCAGGGAACAACTGTCACCGTCTCCTCA | 6 | YES | 8622 |
| JH1_115 | SCAGAATACTTCCAACACTGGGGACAGGGTACATTGGTCACCGTCTCCTCA | 6 | YES | 8623 |
| JH6_135 | KACTACATGGACGTATGGGGCAAGGGTACAACTGTCACCGTCTCCTCA | 6 | YES | 8624 |
| JH6_199 | GKATACGGAATGGACGTATGGGGCCAGGGAACAACTGTCACCGTCTCCTCA | 6 | YES | 8625 |
| JH6_142 | AKCTACGGAATGGACGTATGGGGCCAGGGAACAACTGTCACCGTCTCCTCA | 6 | YES | 8626 |
| JH2_119 | ARCTGGTACTTCGACCTATGGGGAGAGGTACCTTGGTCACCGTCTCCTCA | 6 | YES | 8627 |
| JH6_143 | ASATACGGAATGGACGTATGGGGCCAGGGAACAACTGTCACCGTCTCCTCA | 6 | YES | 8628 |
| JH6_144 | TATTACTATGGTATGGATGTATGGGGCCAGGGAACAACTGTCACCGTCTCCTCA | 7 | | 8629 |
| JH6_145 | TATTACTATTATATGGATGTTTGGGGCAAGGGTACAACTGTCACCGTCTCCTCA | 7 | | 8630 |
| JH6_146 | GATTACTACGGCATGGATGTTTGGGGCCAGGGAACAACTGTCACCGTCTCCTCA | 7 | | 8631 |
| JH6_148 | AACTACTACGGCATGGACGTATGGGGCCAGGGAACAACTGTCACCGTCTCCTCA | 7 | | 8632 |
| JH6_147 | CWCTACTACGGAATGGACGTATGGGGCCAGGGAACAACTGTCACCGTCTCCTCA | 7 | YES | 8633 |
| JH6_150 | RACTACTACTACATGGACGTATGGGGCAAGGGTACAACTGTCACCGTCTCCTCA | 7 | YES | 8634 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH6_149 | YCATACTACGGAATGGACGTATGGGGCCAGGGAACAACTGTCACCGTCTCCTCA | 7 | YES | 8635 |
| JH6_151 | TATTACTACTACGGAATGGACGTTTGGGGCCAGGGAACAACTGTCACCGTCTCCTCA | 8 | | 8636 |
| JH6_152 | AATTATTATTACGGCATGGACGTCTGGGGCCAGGGAACAACTGTCACCGTCTCCTCA | 8 | | 8637 |
| JH6_153 | GATTACTATTACGGTATGGATGTCTGGGGCCAGGGAACAACTGTCACCGTCTCCTCA | 8 | | 8638 |
| JH6_154 | CACTATTACTACGGCATGGACGTATGGGGCCAGGGAACAACTGTCACCGTCTCCTCA | 8 | | 8639 |
| JH6_155 | TTCTATTATTATGGTATGGATGTTTGGGGCCAGGGAACAACTGTCACCGTCTCCTCA | 8 | | 8640 |
| JH6_156 | TCTTACTACTATGGGATGGACGTGTGGGGCCAGGGAACAACTGTCACCGTCTCCTCA | 8 | | 8641 |
| JH6_157 | AGATATTACTACGGCATGGATGTTTGGGGCCAGGGAACAACTGTCACCGTCTCCTCA | 8 | | 8642 |
| JH6_158 | TTATACTACTATGGGATGGATGTATGGGGCCAGGGAACAACTGTCACCGTCTCCTCA | 8 | | 8643 |
| JH6_159 | CCTTACTACTATGGCATGGACGTCTGGGGCCAGGGAACAACTGTCACCGTCTCCTCA | 8 | | 8644 |
| JH6_160 | ACCTATTACTATGGTATGGATGTGTGGGGCCAGGGAACAACTGTCACCGTCTCCTCA | 8 | | 8645 |
| JH6_161 | GGATACTACTATGGGATGGACGTCTGGGGCCAGGGAACAACTGTCACCGTCTCCTCA | 8 | | 8646 |
| JH6_163 | GCCTACTATTATGGCATGGACGTCTGGGGCCAGGGAACAACTGTCACCGTCTCCTCA | 8 | | 8647 |
| JH6_164 | TACTACTATTATTATGGACGTTTGGGGCAAGGGTACAACTGTCACCGTCTCCTCA | 8 | | 8648 |
| JH6_165 | AACTACTACTACTATATGGATGTTTGGGGCAAGGGTACAACTGTCACCGTCTCCTCA | 8 | | 8649 |
| JH6_166 | GATTATTATTACTATATGGACGTCTGGGGCAAGGGTACAACTGTCACCGTCTCCTCA | 8 | | 8650 |
| JH6_162 | RTATACTACTACGGAATGGACGTATGGGGCCAGGGAACAACTGTCACCGTCTCCTCA | 8 | YES | 8651 |
| JH6_168 | RGCTACTACTACTACATGGACGTATGGGGCAAGGGTACAACTGTCACCGTCTCCTCA | 8 | YES | 8652 |
| JH6_167 | CMCTACTACTACTACATGGACGTATGGGGCAAGGGTACAACTGTCACCGTCTCCTCA | 8 | YES | 8653 |
| JH6_169 | TATTACTATTATTACGGGATGGACGTATGGGGCCAGGGAACAACTGTCACCGTCTCCTCA | 9 | | 8654 |
| JH6_170 | AATTATTATTATTATGGGATGGACGTATGGGGCCAGGGAACAACTGTCACCGTCTCCTCA | 9 | | 8655 |
| JH6_171 | GACTATTACTATTATGGAATGGATGTATGGGGCCAGGGAACAACTGTCACCGTCTCCTCA | 9 | | 8656 |
| JH6_172 | CATTATTATTATTACGGAATGGACGTTTGGGGCCAGGGAACAACTGTCACCGTCTCCTCA | 9 | | 8657 |
| JH6_173 | TTCTATTACTATTATGGCATGGATGTGTGGGGCCAGGGAACAACTGTCACCGTCTCCTCA | 9 | | 8658 |
| JH6_174 | AGCTACTACTATTATGGTATGGACGTGTGGGGCCAGGGAACAACTGTCACCGTCTCCTCA | 9 | | 8659 |
| JH6_175 | AGATATTACTACTATGGCATGGATGTCTGGGGCCAGGGAACAACTGTCACCGTCTCCTCA | 9 | | 8660 |
| JH6_176 | TTATACTACTATTACGGCATGGATGTCTGGGGCCAGGGAACAACTGTCACCGTCTCCTCA | 9 | | 8661 |
| JH6_177 | CCCTATTATTACTACGGAATGGACGTTTGGGGCCAGGGAACAACTGTCACCGTCTCCTCA | 9 | | 8662 |
| JH6_178 | ATCTATTACTATTATGGCATGGATGTATGGGGCCAGGGAACAACTGTCACCGTCTCCTCA | 9 | | 8663 |
| JH6_179 | ACCTATTACTACTATGGCATGGACGTTTGGGGCCAGGGAACAACTGTCACCGTCTCCTCA | 9 | | 8664 |
| JH6_180 | GGCTACTATTACTATGGGATGGACGTCTGGGGCCAGGGAACAACTGTCACCGTCTCCTCA | 9 | | 8665 |
| JH6_181 | GTCTACTATTATTATGGCATGGACGTATGGGGCCAGGGAACAACTGTCACCGTCTCCTCA | 9 | | 8666 |
| JH6_182 | GCTTACTATTACTACGGCATGGACGTATGGGGCCAGGGAACAACTGTCACCGTCTCCTCA | 9 | | 8667 |
| JH6_183 | GATTATTATTATTACTATGGTATGGATGTGTGGGGCCAGGGAACAACTGTCACCGTCTCCTCA | 10 | | 8668 |
| JH6_184 | TACTATTACTACTATTATGGCATGGACGTCTGGGGCCAGGGAACAACTGTCACCGTCTCCTCA | 10 | | 8669 |
| JH6_185 | CACTACTACTATTATTATGGGATGGACGTATGGGGCCAGGGAACAACTGTCACCGTCTCCTCA | 10 | | 8670 |
| JH6_186 | TTCTATTATTATTATTACGGAATGGACGTCTGGGGCCAGGGAACAACTGTCACCGTCTCCTCA | 10 | | 8671 |

TABLE 31-continued

Theoretical segment pool of oligonucleotides encoding JH segments of Example 15.

| Name | Degenerate Oligo | Peptide Length | Degenerate | SEQ ID NO |
|---|---|---|---|---|
| JH6_187 | AGCTACTATTACTACTATGGGATGGATGTGTGGGGCCAGGGAACAACTGTCACCGTCTCCTCA | 10 | | 8672 |
| JH6_188 | AGATATTATTATTACTATGGTATGGACGTTTGGGGCCAGGGAACAACTGTCACCGTCTCCTCA | 10 | | 8673 |
| JH6_189 | TTGTACTATTACTATTATGGAATGGACGTTTGGGGCCAGGGAACAACTGTCACCGTCTCCTCA | 10 | | 8674 |
| JH6_190 | CCTTACTATTATTATTATGGGATGGATGTCTGGGGCCAGGGAACAACTGTCACCGTCTCCTCA | 10 | | 8675 |
| JH6_191 | ATATATTACTATTACTACGGGATGGATGTTTGGGGCCAGGGAACAACTGTCACCGTCTCCTCA | 10 | | 8676 |
| JH6_192 | ACCTACTATTATTATTACGGGATGGACGTTTGGGGCCAGGGAACAACTGTCACCGTCTCCTCA | 10 | | 8677 |
| JH6_193 | GGTTACTATTATTACTACGGGATGGACGTGTGGGGCCAGGGAACAACTGTCACCGTCTCCTCA | 10 | | 8678 |
| JH6_194 | GTGTATTACTATTACTACGGGATGGACGTGTGGGGCCAGGGAACAACTGTCACCGTCTCCTCA | 10 | | 8679 |
| JH6_195 | GCCTATTACTACTATGGGATGGATGTGTGGGGCCAGGGAACAACTGTCACCGTCTCCTCA | 10 | | 8680 |
| JH6_196 | AATTATTATTACTATTACGGTATGGACGTGTGGGGCCAGGGAACAACTGTCACCGTCTCCTCA | 10 | | 8681 |
| JH6_197 | KACTACTACTACTACTACATGGACGTATGGGGCAAGGGTACAACTGTCACCGTCTCCTCA | 10 | YES | 8682 |

TABLE 32

Theoretical segment pool of unique H3-JH polypeptide segments encoded by the oligonucleotides of Table 31.

| Name | Sequence | Length | SEQ ID NO |
|---|---|---|---|
| PJH4_001 | | 0 | n/a |
| PJH1_002 | H | 1 | n/a |
| PJH1_003 | I | 1 | n/a |
| PJH1_004 | Y | 1 | n/a |
| PJH1_005 | P | 1 | n/a |
| PJH1_006 | V | 1 | n/a |
| PJH1_007 | D | 1 | n/a |
| PJH1_008 | F | 1 | n/a |
| PJH1_009 | N | 1 | n/a |
| PJH1_010 | S | 1 | n/a |
| PJH1_011 | T | 1 | n/a |
| PJH1_200 | A | 1 | n/a |
| PJH4_013 | DY | 2 | n/a |
| PJH4_016 | AY | 2 | n/a |
| PJH4_017 | FY | 2 | n/a |
| PJH4_018 | GY | 2 | n/a |
| PJH4_019 | HY | 2 | n/a |
| PJH4_023 | SY | 2 | n/a |
| PJH4_024 | VY | 2 | n/a |
| PJH4_025 | YY | 2 | n/a |
| PJH3_012A | NI | 2 | n/a |
| PJH3_012B | DI | 2 | n/a |
| PJH3_015A | NV | 2 | n/a |
| PJH3_015B | DV | 2 | n/a |
| PJH4_020A | LY | 2 | n/a |
| PJH4_020B | IY | 2 | n/a |
| PJH4_021A | NY | 2 | n/a |
| PJH4_021B | TY | 2 | n/a |
| PJH4_022A | PY | 2 | n/a |
| PJH4_022B | RY | 2 | n/a |
| PJH5_014A | NP | 2 | n/a |
| PJH5_014B | DP | 2 | n/a |
| PJH4_029 | FDY | 3 | n/a |
| PJH4_030 | IDY | 3 | n/a |
| PJH4_031 | VDY | 3 | n/a |
| PJH4_032 | LDY | 3 | n/a |
| PJH4_033 | SDY | 3 | n/a |
| PJH4_034 | HDY | 3 | n/a |
| PJH4_035 | RDY | 3 | n/a |
| PJH4_036 | PDY | 3 | n/a |
| PJH4_037 | NDY | 3 | n/a |
| PJH4_038 | TDY | 3 | n/a |

TABLE 32-continued

Theoretical segment pool of unique H3-JH polypeptide segments encoded by the oligonucleotides of Table 31.

| Name | Sequence | Length | SEQ ID NO |
|---|---|---|---|
| PJH4_039 | DDY | 3 | n/a |
| PJH4_040 | GDY | 3 | n/a |
| PJH4_041 | ADY | 3 | n/a |
| PJH4_042 | YDY | 3 | n/a |
| PJH5_043 | FDP | 3 | n/a |
| PJH6_044 | MDV | 3 | n/a |
| PJH1_026A | LQH | 3 | n/a |
| PJH1_026B | FQH | 3 | n/a |
| PJH2_027A | FDL | 3 | n/a |
| PJH2_027B | LDL | 3 | n/a |
| PJH3_028A | FDI | 3 | n/a |
| PJH3_028B | LDI | 3 | n/a |
| PJH3_046A | VDV | 3 | n/a |
| PJH3_046B | LDV | 3 | n/a |
| PJH5_045A | LDP | 3 | n/a |
| PJH5_045B | SDP | 3 | n/a |
| PJH3_049 | AFDI | 4 | 4539 |
| PJH4_051 | YFDY | 4 | 4567 |
| PJH4_052 | NFDY | 4 | 4580 |
| PJH4_053 | DFDY | 4 | 4581 |
| PJH4_054 | HFDY | 4 | 4582 |
| PJH4_055 | FFDY | 4 | 4583 |
| PJH4_056 | SFDY | 4 | 4584 |
| PJH4_057 | RFDY | 4 | 4585 |
| PJH4_058 | LFDY | 4 | 4586 |
| PJH4_059 | PFDY | 4 | 4587 |
| PJH4_060 | IFDY | 4 | 4588 |
| PJH4_061 | TFDY | 4 | 4589 |
| PJH4_062 | GFDY | 4 | 4590 |
| PJH4_063 | VFDY | 4 | 4591 |
| PJH4_064 | AFDY | 4 | 4592 |
| PJH5_065 | WFDP | 4 | 4596 |
| PJH6_068 | GMDV | 4 | 4641 |
| PJH1_047A | YFQH | 4 | 4489 |
| PJH1_047B | DFQH | 4 | 4514 |
| PJH2_048A | DFDL | 4 | 4537 |
| PJH2_048B | YFDL | 4 | 4529 |
| PJH3_050A | PFDI | 4 | 4554 |
| PJH3_050B | SFDI | 4 | 4553 |
| PJH3_198A | VFDI | 4 | 4563 |
| PJH3_198B | LFDI | 4 | 4558 |
| PJH5_066A | RFDP | 4 | 4622 |
| PJH5_066B | SFDP | 4 | 4625 |
| PJH5_067A | GFDP | 4 | 4623 |
| PJH5_067B | AFDP | 4 | 4633 |
| PJH6_069A | YMDV | 4 | 4687 |
| PJH6_069B | DMDV | 4 | 8683 |
| PJH6_070A | PMDV | 4 | 8684 |
| PJH6_070B | SMDV | 4 | 8685 |
| PJH2_072 | WYFDL | 5 | 4528 |
| PJH3_075 | DAFDI | 5 | 4538 |
| PJH3_076 | YAFDI | 5 | 4540 |
| PJH3_077 | HAFDI | 5 | 4541 |
| PJH3_078 | FAFDI | 5 | 4542 |
| PJH3_079 | SAFDI | 5 | 4543 |
| PJH3_080 | RAFDI | 5 | 4544 |
| PJH3_081 | LAFDI | 5 | 4545 |
| PJH3_082 | GAFDI | 5 | 4549 |
| PJH4_086 | DYFDY | 5 | 4566 |
| PJH4_087 | YYFDY | 5 | 4568 |
| PJH4_088 | HYFDY | 5 | 4569 |
| PJH4_089 | FYFDY | 5 | 4570 |
| PJH4_090 | SYFDY | 5 | 4571 |
| PJH4_091 | RYFDY | 5 | 4572 |
| PJH4_092 | LYFDY | 5 | 4573 |
| PJH4_093 | PYFDY | 5 | 4574 |
| PJH4_095 | GYFDY | 5 | 4577 |
| PJH4_096 | VYFDY | 5 | 4578 |
| PJH4_097 | AYFDY | 5 | 4579 |
| PJH4_098 | NYFDY | 5 | 4593 |
| PJH5_099 | NWFDP | 5 | 4595 |
| PJH5_100 | DWFDP | 5 | 4609 |
| PJH5_101 | YWFDP | 5 | 4610 |
| PJH5_102 | HWFDP | 5 | 4611 |

TABLE 32-continued

Theoretical segment pool of unique H3-JH polypeptide segments encoded by the oligonucleotides of Table 31.

| Name | Sequence | Length | SEQ ID NO |
|---|---|---|---|
| PJH5_103 | FWFDP | 5 | 4612 |
| PJH5_104 | SWFDP | 5 | 4613 |
| PJH5_105 | RWFDP | 5 | 4614 |
| PJH5_107 | GWFDP | 5 | 4619 |
| PJH5_109 | AWFDP | 5 | 4621 |
| PJH6_110 | YGMDV | 5 | 4640 |
| PJH6_112 | DGMDV | 5 | 8686 |
| PJH1_071A | EYFQH | 5 | 4488 |
| PJH1_071B | KYFQH | 5 | 4502 |
| PJH2_073A | SYFDL | 5 | 8687 |
| PJH2_073B | GYFDL | 5 | 4533 |
| PJH2_074A | RYFDL | 5 | 4534 |
| PJH2_074B | LYFDL | 5 | 8688 |
| PJH3_083A | IAFDI | 5 | 4547 |
| PJH3_083B | VAFDI | 5 | 4550 |
| PJH3_084A | PAFDI | 5 | 4546 |
| PJH3_084B | AAFDI | 5 | 4551 |
| PJH3_085A | NAFDI | 5 | 4565 |
| PJH3_085B | TAFDI | 5 | 4548 |
| PJH4_094A | IYFDY | 5 | 4575 |
| PJH4_094B | TYFDY | 5 | 4576 |
| PJH5_106A | PWFDP | 5 | 4616 |
| PJH5_106B | TWFDP | 5 | 4618 |
| PJH5_108A | IWFDP | 5 | 4617 |
| PJH5_108B | VWFDP | 5 | 4620 |
| PJH6_111A | YYMDV | 5 | 4686 |
| PJH6_111B | DYMDV | 5 | 8689 |
| PJH6_113A | HGMDV | 5 | 8690 |
| PJH6_113B | LGMDV | 5 | 8691 |
| PJH6_114A | SGMDV | 5 | 8692 |
| PJH6_114B | AGMDV | 5 | 8693 |
| PJH2_116 | YWYFDL | 6 | 4527 |
| PJH2_117 | DWYFDL | 6 | 4530 |
| PJH5_120 | DNWFDP | 6 | 4594 |
| PJH5_121 | YNWFDP | 6 | 4597 |
| PJH5_122 | HNWFDP | 6 | 4598 |
| PJH5_123 | FNWFDP | 6 | 4599 |
| PJH5_124 | SNWFDP | 6 | 4600 |
| PJH5_125 | RNWFDP | 6 | 4601 |
| PJH5_126 | LNWFDP | 6 | 4602 |
| PJH5_127 | PNWFDP | 6 | 4603 |
| PJH5_128 | INWFDP | 6 | 4604 |
| PJH5_129 | TNWFDP | 6 | 4605 |
| PJH5_130 | GNWFDP | 6 | 4606 |
| PJH5_131 | VNWFDP | 6 | 4607 |
| PJH5_132 | ANWFDP | 6 | 4608 |
| PJH5_133 | NNWFDP | 6 | 4634 |
| PJH6_134 | YYGMDV | 6 | 4639 |
| PJH6_136 | DYGMDV | 6 | 8694 |
| PJH6_137 | FYGMDV | 6 | 8695 |
| PJH6_138 | HYGMDV | 6 | 8696 |
| PJH6_139 | LYGMDV | 6 | 8697 |
| PJH6_140 | NYGMDV | 6 | 8698 |
| PJH1_115A | AEYFQH | 6 | 4526 |
| PJH1_115B | PEYFQH | 6 | 4491 |
| PJH2_118A | LWYFDL | 6 | 8699 |
| PJH2_118B | HWYFDL | 6 | 4531 |
| PJH2_119A | NWYFDL | 6 | 4532 |
| PJH2_119B | SWYFDL | 6 | 8700 |
| PJH6_135A | DYYMDV | 6 | 8701 |
| PJH6_135B | YYYMDV | 6 | 4685 |
| PJH6_141A | AYGMDV | 6 | 8702 |
| PJH6_141B | PYGMDV | 6 | 8703 |
| PJH6_142A | SYGMDV | 6 | 8704 |
| PJH6_142B | IYGMDV | 6 | 8705 |
| PJH6_143A | TYGMDV | 6 | 8706 |
| PJH6_143B | RYGMDV | 6 | 8707 |
| PJH6_199A | GYGMDV | 6 | 8708 |
| PJH6_199B | VYGMDV | 6 | 8709 |
| PJH6_144 | YYYGMDV | 7 | 4638 |
| PJH6_145 | YYYYMDV | 7 | 4684 |
| PJH6_146 | DYYGMDV | 7 | 8710 |
| PJH6_148 | NYYGMDV | 7 | 8711 |
| PJH6_147A | LYYGMDV | 7 | 8712 |

TABLE 32-continued

Theoretical segment pool of unique H3-JH polypeptide segments encoded by the oligonucleotides of Table 31.

| Name | Sequence | Length | SEQ ID NO |
|---|---|---|---|
| PJH6_147B | HYYGMDV | 7 | 8713 |
| PJH6_149A | SYYGMDV | 7 | 8714 |
| PJH6_149B | PYYGMDV | 7 | 8715 |
| PJH6_150A | NYYYMDV | 7 | 8716 |
| PJH6_150B | DYYYMDV | 7 | 8717 |
| PJH6_151 | YYYYGMDV | 8 | 4637 |
| PJH6_152 | NYYYGMDV | 8 | 4667 |
| PJH6_153 | DYYYGMDV | 8 | 4668 |
| PJH6_154 | HYYYGMDV | 8 | 4669 |
| PJH6_155 | FYYYGMDV | 8 | 4670 |
| PJH6_156 | SYYYGMDV | 8 | 4671 |
| PJH6_157 | RYYYGMDV | 8 | 4672 |
| PJH6_158 | LYYYGMDV | 8 | 4673 |
| PJH6_159 | PYYYGMDV | 8 | 4674 |
| PJH6_160 | TYYYGMDV | 8 | 4676 |
| PJH6_161 | GYYYGMDV | 8 | 4677 |
| PJH6_163 | AYYYGMDV | 8 | 4679 |
| PJH6_164 | YYYYYMDV | 8 | 4683 |
| PJH6_165 | NYYYYMDV | 8 | 4713 |
| PJH6_166 | DYYYYMDV | 8 | 4714 |
| PJH6_162A | VYYYGMDV | 8 | 4678 |
| PJH6_162B | IYYYGMDV | 8 | 4675 |
| PJH6_167A | HYYYYMDV | 8 | 4715 |
| PJH6_167B | PYYYYMDV | 8 | 4720 |
| PJH6_168A | SYYYYMDV | 8 | 4717 |
| PJH6_168B | GYYYYMDV | 8 | 4723 |
| PJH6_169 | YYYYYGMDV | 9 | 4636 |
| PJH6_170 | NYYYYGMDV | 9 | 4654 |
| PJH6_171 | DYYYYGMDV | 9 | 4655 |
| PJH6_172 | HYYYYGMDV | 9 | 4656 |
| PJH6_173 | FYYYYGMDV | 9 | 4657 |
| PJH6_174 | SYYYYGMDV | 9 | 4658 |
| PJH6_175 | RYYYYGMDV | 9 | 4659 |
| PJH6_176 | LYYYYGMDV | 9 | 4660 |
| PJH6_177 | PYYYYGMDV | 9 | 4661 |
| PJH6_178 | IYYYYGMDV | 9 | 4662 |
| PJH6_179 | TYYYYGMDV | 9 | 4663 |
| PJH6_180 | GYYYYGMDV | 9 | 4664 |
| PJH6_181 | VYYYYGMDV | 9 | 4665 |
| PJH6_182 | AYYYYGMDV | 9 | 4666 |
| PJH6_183 | DYYYYYGMDV | 10 | 4635 |
| PJH6_184 | YYYYYYGMDV | 10 | 4642 |
| PJH6_185 | HYYYYYGMDV | 10 | 4643 |
| PJH6_186 | FYYYYYGMDV | 10 | 4644 |
| PJH6_187 | SYYYYYGMDV | 10 | 4645 |
| PJH6_188 | RYYYYYGMDV | 10 | 4646 |
| PJH6_189 | LYYYYYGMDV | 10 | 4647 |
| PJH6_190 | PYYYYYGMDV | 10 | 4648 |
| PJH6_191 | IYYYYYGMDV | 10 | 4649 |
| PJH6_192 | TYYYYYGMDV | 10 | 4650 |
| PJH6_193 | GYYYYYGMDV | 10 | 4651 |
| PJH6_194 | VYYYYYGMDV | 10 | 4652 |
| PJH6_195 | AYYYYYGMDV | 10 | 4653 |
| PJH6_196 | NYYYYYGMDV | 10 | 4680 |
| PJH6_197A | DYYYYYYMDV | 10 | 4681 |
| PJH6_197B | YYYYYYYMDV | 10 | 4688 |

EQUIVALENTS

Those skilled in the art will recognize, or be able to ascertain using no more than routine experimentation, many equivalents to the specific embodiments and methods described herein. Such equivalents are intended to be encompassed by the scope of the following claims.

APPENDIX A

GI NUMBERS OF 3,571 SEQUENCES IN THE HEALTHY PREIMMUNE SET (HPS)

| | | | |
|---|---|---|---|
| 33628 | 1052674 | 1685242 | 1770847 |
| 37745 | 1052676 | 1685246 | 1770848 |
| 37747 | 1052683 | 1685248 | 1770851 |
| 37749 | 1052685 | 1685250 | 1770852 |
| 37751 | 1052691 | 1685252 | 1770853 |
| 37753 | 1052692 | 1685254 | 1770854 |
| 37755 | 1052693 | 1685256 | 1770855 |
| 37757 | 1052695 | 1685258 | 1770860 |
| 37759 | 1154682 | 1685260 | 1770861 |
| 37761 | 1154691 | 1685264 | 1770865 |
| 37763 | 1154698 | 1685266 | 1770866 |
| 37765 | 1154699 | 1685268 | 1770867 |
| 37767 | 1154706 | 1770744 | 1770869 |
| 37769 | 1154710 | 1770746 | 1770870 |
| 37773 | 1154713 | 1770747 | 1770872 |
| 37777 | 1154715 | 1770751 | 1770874 |
| 38383 | 1154724 | 1770755 | 1770875 |
| 38391 | 1154754 | 1770756 | 1770876 |
| 38393 | 1154769 | 1770758 | 1770877 |

APPENDIX A-continued

GI NUMBERS OF 3,571 SEQUENCES IN THE HEALTHY PREIMMUNE SET (HPS)

| | | | |
|---|---|---|---|
| 38397 | 1154770 | 1770759 | 1770878 |
| 38401 | 1154805 | 1770761 | 1770879 |
| 185292 | 1154807 | 1770763 | 1770880 |
| 264183 | 1154808 | 1770765 | 1770881 |
| 297147 | 1154809 | 1770766 | 1770882 |
| 306949 | 1154810 | 1770770 | 1770883 |
| 306951 | 1154811 | 1770771 | 1770884 |
| 306953 | 1154813 | 1770772 | 1770885 |
| 483332 | 1154818 | 1770775 | 1770887 |
| 483333 | 1154820 | 1770776 | 1770888 |
| 483335 | 1154822 | 1770777 | 1770891 |
| 483336 | 1154824 | 1770779 | 1770892 |
| 483338 | 1154825 | 1770780 | 1770893 |
| 483339 | 1154834 | 1770783 | 1770894 |
| 483348 | 1154837 | 1770784 | 1770895 |
| 483350 | 1154838 | 1770785 | 1770896 |
| 510999 | 1154839 | 1770789 | 1770898 |
| 547164 | 1154840 | 1770791 | 1770902 |
| 587252 | 1154841 | 1770792 | 1770904 |
| 587254 | 1154843 | 1770793 | 1770905 |
| 587266 | 1154844 | 1770794 | 1770906 |
| 587276 | 1154845 | 1770795 | 1770908 |
| 587278 | 1154847 | 1770796 | 1770909 |
| 587280 | 1154848 | 1770797 | 1770910 |
| 587286 | 1197299 | 1770799 | 1770911 |
| 587288 | 1197300 | 1770800 | 1770912 |
| 587291 | 1197304 | 1770801 | 1770913 |
| 587293 | 1197307 | 1770805 | 1770914 |
| 587295 | 1197308 | 1770806 | 1770915 |
| 587299 | 1197309 | 1770807 | 1770916 |
| 587301 | 1197312 | 1770808 | 1770918 |
| 587304 | 1197313 | 1770809 | 1770922 |
| 587306 | 1197314 | 1770810 | 1770932 |
| 587308 | 1197315 | 1770811 | 1770936 |
| 587311 | 1197316 | 1770812 | 1770937 |
| 587313 | 1197318 | 1770813 | 1770950 |
| 587315 | 1197319 | 1770814 | 1770952 |
| 587317 | 1197321 | 1770815 | 1770954 |
| 1052611 | 1197322 | 1770816 | 1770958 |
| 1052620 | 1197323 | 1770817 | 1770961 |
| 1052622 | 1197324 | 1770818 | 1770962 |
| 1052626 | 1197325 | 1770820 | 1770963 |
| 1052627 | 1197326 | 1770822 | 1770964 |
| 1052634 | 1197327 | 1770824 | 1770967 |
| 1052637 | 1197328 | 1770826 | 1770969 |
| 1052639 | 1495508 | 1770829 | 1770971 |
| 1052640 | 1495511 | 1770830 | 1770972 |
| 1052642 | 1495512 | 1770831 | 1770974 |
| 1052644 | 1495516 | 1770833 | 1770976 |
| 1052655 | 1495518 | 1770835 | 1770979 |
| 1052656 | 1592729 | 1770836 | 1770981 |
| 1052657 | 1685210 | 1770837 | 1770982 |
| 1052658 | 1685220 | 1770839 | 1770983 |
| 1052659 | 1685222 | 1770840 | 1770989 |
| 1052662 | 1685228 | 1770843 | 1770992 |
| 1052668 | 1685234 | 1770844 | 1770994 |
| 1052669 | 1685238 | 1770845 | 1770995 |
| 1052671 | 1685240 | 1770846 | 1770997 |
| 1770998 | 1791142 | 3170752 | 3170974 |
| 1771002 | 1791144 | 3170754 | 3170978 |
| 1771004 | 1791152 | 3170756 | 3170980 |
| 1771008 | 1791154 | 3170758 | 3170984 |
| 1771010 | 1791160 | 3170760 | 3170986 |
| 1771014 | 1791164 | 3170762 | 3170988 |
| 1771016 | 1791176 | 3170764 | 3170990 |
| 1771017 | 1791182 | 3170766 | 3170992 |
| 1771018 | 1791184 | 3170768 | 3171006 |
| 1771022 | 1791186 | 3170772 | 3171008 |
| 1771026 | 1791190 | 3170774 | 3171010 |
| 1771027 | 1791194 | 3170778 | 3171016 |
| 1771029 | 1791196 | 3170782 | 3171018 |
| 1771033 | 1791200 | 3170784 | 3171020 |
| 1771034 | 1791204 | 3170786 | 3171022 |
| 1771035 | 1791206 | 3170788 | 3171024 |
| 1771036 | 1869905 | 3170794 | 3171026 |
| 1771038 | 1869907 | 3170796 | 3171028 |
| 1771039 | 1869912 | 3170802 | 3171030 |
| 1771042 | 1869913 | 3170808 | 3171038 |
| 1771044 | 1869915 | 3170810 | 3171040 |
| 1771045 | 1869918 | 3170812 | 3171042 |
| 1771055 | 1869919 | 3170816 | 3171044 |
| 1771057 | 1934921 | 3170820 | 3171242 |
| 1771058 | 2367538 | 3170822 | 3608440 |
| 1771059 | 2388836 | 3170824 | 3608462 |
| 1771060 | 2388837 | 3170826 | 3954953 |
| 1771061 | 2388839 | 3170830 | 3954955 |
| 1771063 | 2388840 | 3170832 | 4530538 |
| 1791008 | 2388841 | 3170834 | 4530544 |
| 1791010 | 2388842 | 3170836 | 4753741 |
| 1791012 | 2388843 | 3170840 | 4959477 |
| 1791018 | 2388846 | 3170842 | 4995315 |
| 1791020 | 2388847 | 3170844 | 4995317 |
| 1791026 | 2388848 | 3170846 | 4995319 |
| 1791028 | 2388851 | 3170848 | 4995321 |
| 1791030 | 2388852 | 3170852 | 4995323 |
| 1791032 | 2388853 | 3170854 | 4995325 |
| 1791034 | 2388856 | 3170856 | 4995327 |
| 1791036 | 2388859 | 3170858 | 4995329 |
| 1791040 | 2388861 | 3170862 | 4995331 |
| 1791042 | 2388862 | 3170864 | 4995333 |
| 1791046 | 2388863 | 3170866 | 4995335 |
| 1791050 | 2388864 | 3170868 | 4995337 |
| 1791052 | 2388865 | 3170870 | 4995339 |
| 1791054 | 2388868 | 3170872 | 4995341 |
| 1791058 | 2388871 | 3170874 | 4995343 |
| 1791060 | 2388873 | 3170876 | 4995345 |
| 1791062 | 2388875 | 3170878 | 4995347 |
| 1791064 | 2388876 | 3170880 | 4995349 |
| 1791072 | 2388878 | 3170882 | 4995351 |
| 1791074 | 2773082 | 3170884 | 4995353 |
| 1791076 | 3170658 | 3170890 | 4995355 |
| 1791078 | 3170662 | 3170894 | 4995357 |
| 1791080 | 3170664 | 3170898 | 4995359 |
| 1791082 | 3170668 | 3170902 | 4995361 |
| 1791084 | 3170670 | 3170908 | 4995365 |
| 1791086 | 3170686 | 3170910 | 4995367 |
| 1791088 | 3170688 | 3170916 | 4995375 |
| 1791090 | 3170692 | 3170918 | 4995383 |
| 1791096 | 3170694 | 3170922 | 4995385 |
| 1791098 | 3170696 | 3170924 | 4995389 |
| 1791100 | 3170702 | 3170926 | 4995391 |
| 1791104 | 3170704 | 3170930 | 4995393 |
| 1791106 | 3170712 | 3170932 | 4995397 |
| 1791108 | 3170714 | 3170934 | 4995399 |
| 1791110 | 3170716 | 3170936 | 4995400 |
| 1791112 | 3170720 | 3170938 | 4995404 |
| 1791114 | 3170722 | 3170944 | 4995406 |
| 1791116 | 3170726 | 3170946 | 4995408 |
| 1791118 | 3170728 | 3170954 | 4995410 |
| 1791122 | 3170730 | 3170958 | 4995418 |
| 1791124 | 3170734 | 3170960 | 4995422 |
| 1791130 | 3170736 | 3170964 | 4995426 |
| 1791132 | 3170738 | 3170966 | 4995428 |
| 1791134 | 3170740 | 3170968 | 4995430 |
| 1791136 | 3170748 | 3170970 | 4995432 |
| 4995434 | 5834089 | 6531600 | 8489286 |
| 4995436 | 5834091 | 6723523 | 8489289 |
| 4995438 | 5834093 | 6723525 | 8489291 |
| 4995440 | 5834095 | 6723527 | 11137164 |
| 4995442 | 5834097 | 6723531 | 11137170 |
| 4995446 | 5834099 | 6723535 | 11137172 |
| 4995456 | 5834101 | 6723537 | 11137174 |
| 4995462 | 5834103 | 6723543 | 11137178 |
| 4995466 | 5834105 | 6723545 | 11137183 |
| 4995470 | 5834107 | 6723549 | 11137186 |
| 4995474 | 5834109 | 6723551 | 11137188 |
| 4995476 | 5834113 | 6723558 | 11137196 |
| 4995478 | 5834115 | 6723565 | 11137200 |
| 4995480 | 5834119 | 6723581 | 11137205 |
| 4995482 | 5834121 | 6723583 | 11137215 |
| 4995484 | 5834123 | 6723595 | 11137219 |
| 4995486 | 5834125 | 6723597 | 11137229 |
| 4995488 | 5834127 | 6723599 | 11137231 |
| 4995490 | 5834129 | 7161042 | 11137242 |

APPENDIX A-continued

GI NUMBERS OF 3,571 SEQUENCES IN THE
HEALTHY PREIMMUNE SET (HPS)

| | | | |
|---|---|---|---|
| 4995492 | 5834131 | 7161061 | 11137251 |
| 4995494 | 5834133 | 7161129 | 11137253 |
| 4995496 | 5834135 | 7161136 | 11137261 |
| 4995498 | 5834137 | 7161164 | 11137262 |
| 4995500 | 5834139 | 8249510 | 11137274 |
| 4995502 | 5834141 | 8249514 | 11137276 |
| 4995504 | 5834143 | 8249518 | 11137279 |
| 4995506 | 5834145 | 8249524 | 11137281 |
| 4995508 | 5834147 | 8249528 | 11137283 |
| 4995510 | 5834149 | 8249538 | 11137285 |
| 4995512 | 5834151 | 8249546 | 11137289 |
| 4995514 | 5834153 | 8249552 | 11137290 |
| 4995516 | 5834155 | 8249554 | 11137293 |
| 4995520 | 5834159 | 8249558 | 11137295 |
| 4995524 | 5834161 | 8249560 | 11137298 |
| 4995530 | 5834163 | 8249562 | 11137301 |
| 4995535 | 5834165 | 8249566 | 11137303 |
| 4995537 | 5834169 | 8249568 | 11137305 |
| 4995539 | 5834175 | 8249608 | 11137307 |
| 4995549 | 5834177 | 8249622 | 11137309 |
| 4995555 | 5834179 | 8249632 | 11137313 |
| 4995557 | 5834183 | 8249650 | 11137315 |
| 4995563 | 5834185 | 8249652 | 11137317 |
| 4995569 | 5834187 | 8249654 | 11137319 |
| 4995575 | 5834191 | 8249656 | 11137322 |
| 4995581 | 5834193 | 8249662 | 11137326 |
| 4995589 | 5834195 | 8249674 | 11137329 |
| 4995591 | 5834197 | 8249682 | 11137333 |
| 5833973 | 5834199 | 8249698 | 11137335 |
| 5833980 | 5834201 | 8249712 | 11137339 |
| 5833984 | 5834203 | 8249716 | 11137343 |
| 5833986 | 5834205 | 8249718 | 11137348 |
| 5834003 | 5834207 | 8249730 | 11137350 |
| 5834011 | 5834209 | 8249738 | 11137352 |
| 5834015 | 5834213 | 8249740 | 11137354 |
| 5834019 | 5834215 | 8249744 | 11137359 |
| 5834031 | 6013039 | 8249754 | 11137361 |
| 5834035 | 6013043 | 8249756 | 11137363 |
| 5834037 | 6013045 | 8249760 | 11137365 |
| 5834039 | 6531445 | 8249772 | 11137367 |
| 5834041 | 6531457 | 8249778 | 11137369 |
| 5834043 | 6531461 | 8249784 | 11137371 |
| 5834047 | 6531465 | 8249786 | 11137373 |
| 5834049 | 6531481 | 8249788 | 11137375 |
| 5834051 | 6531489 | 8249790 | 11137377 |
| 5834053 | 6531493 | 8249812 | 11137379 |
| 5834055 | 6531495 | 8249816 | 11137382 |
| 5834057 | 6531507 | 8249826 | 11137386 |
| 5834059 | 6531509 | 8249828 | 11137388 |
| 5834065 | 6531511 | 8249838 | 11137392 |
| 5834069 | 6531513 | 8250248 | 11137399 |
| 5834071 | 6531517 | 8250255 | 11137403 |
| 5834073 | 6531521 | 8489274 | 11137407 |
| 5834075 | 6531525 | 8489276 | 11137411 |
| 5834077 | 6531533 | 8489278 | 11137413 |
| 5834079 | 6531537 | 8489280 | 11137415 |
| 5834081 | 6531539 | 8489282 | 11137418 |
| 5834083 | 6531554 | 8489284 | 11137420 |
| 11137422 | 13172069 | 21702275 | 47846518 |
| 11137426 | 13172073 | 21702277 | 47846520 |
| 11137428 | 13172083 | 21702281 | 47846524 |
| 11137430 | 13172091 | 21702282 | 47846526 |
| 11137432 | 13172093 | 21702287 | 47846528 |
| 11137439 | 13172099 | 21702289 | 47846530 |
| 11137441 | 13172117 | 21702291 | 47846532 |
| 11137445 | 13172125 | 21702293 | 47846534 |
| 11137448 | 13172129 | 21702295 | 47846538 |
| 11137450 | 13172133 | 21702297 | 47846540 |
| 11137452 | 13172135 | 21702299 | 47846542 |
| 11137454 | 13172137 | 21702301 | 47846544 |
| 11137460 | 13172141 | 21702303 | 47846546 |
| 11137462 | 13172143 | 21702305 | 47846548 |
| 11137467 | 13172147 | 21702307 | 47846550 |
| 11137470 | 13172149 | 21702309 | 47846558 |
| 11137474 | 13172151 | 21702311 | 47846562 |
| 11137476 | 13172155 | 21702313 | 47846564 |
| 11137480 | 13172157 | 21702314 | 47846566 |
| 11137482 | 13172159 | 21702315 | 47846570 |
| 11137487 | 13172163 | 23337033 | 47846572 |
| 11137494 | 13172169 | 27370812 | 47846574 |
| 11137500 | 13172177 | 31076438 | 47846578 |
| 11137502 | 13623574 | 33873883 | 47846580 |
| 11137507 | 14289029 | 33989177 | 47846582 |
| 11137509 | 14289035 | 37987904 | 47846586 |
| 13171905 | 14289037 | 37987932 | 47846588 |
| 13171909 | 14289049 | 37987938 | 47846590 |
| 13171911 | 14289057 | 37987960 | 47846594 |
| 13171913 | 14289061 | 37987970 | 47846596 |
| 13171915 | 14289065 | 39644659 | 47846598 |
| 13171917 | 14289067 | 39645530 | 47846600 |
| 13171921 | 14289071 | 47846366 | 47846602 |
| 13171923 | 14289073 | 47846370 | 47846604 |
| 13171925 | 14289079 | 47846372 | 47846606 |
| 13171927 | 14289097 | 47846376 | 47846612 |
| 13171929 | 14289099 | 47846378 | 47846614 |
| 13171931 | 14289109 | 47846380 | 47846618 |
| 13171935 | 14289111 | 47846386 | 47846620 |
| 13171937 | 16075408 | 47846388 | 47846626 |
| 13171939 | 16075410 | 47846394 | 47846632 |
| 13171941 | 16075412 | 47846398 | 47846644 |
| 13171945 | 16075414 | 47846416 | 47846646 |
| 13171947 | 16075416 | 47846418 | 47846658 |
| 13171949 | 16075418 | 47846420 | 47846660 |
| 13171951 | 16075420 | 47846422 | 47846664 |
| 13171953 | 16075422 | 47846426 | 47846666 |
| 13171955 | 16075424 | 47846428 | 47846674 |
| 13171957 | 16075426 | 47846430 | 47846678 |
| 13171959 | 16075428 | 47846432 | 47846680 |
| 13171961 | 16075430 | 47846434 | 47846684 |
| 13171965 | 16075432 | 47846438 | 47846690 |
| 13171967 | 16075434 | 47846442 | 47846692 |
| 13171969 | 16075436 | 47846446 | 47846696 |
| 13171971 | 16075438 | 47846448 | 47846698 |
| 13171973 | 16075440 | 47846450 | 47846716 |
| 13171975 | 16075442 | 47846456 | 47846718 |
| 13171977 | 16075444 | 47846458 | 47846724 |
| 13171981 | 16075448 | 47846466 | 47846728 |
| 13171987 | 16075450 | 47846468 | 47846730 |
| 13171999 | 16075452 | 47846472 | 47846734 |
| 13172003 | 16075454 | 47846476 | 47846750 |
| 13172005 | 16075456 | 47846478 | 47846752 |
| 13172007 | 16075458 | 47846482 | 47846756 |
| 13172009 | 16075460 | 47846484 | 47846762 |
| 13172013 | 16075464 | 47846486 | 47846764 |
| 13172019 | 16075466 | 47846488 | 47846768 |
| 13172021 | 16076270 | 47846490 | 47846778 |
| 13172025 | 16076286 | 47846492 | 47846782 |
| 13172027 | 17511791 | 47846494 | 47846784 |
| 13172033 | 18044958 | 47846498 | 47846786 |
| 13172037 | 19171939 | 47846506 | 49256420 |
| 13172043 | 19550754 | 47846508 | 49256426 |
| 13172045 | 19848531 | 47846510 | 49258105 |
| 13172053 | 19848533 | 47846512 | 49523831 |
| 13172061 | 19848543 | 47846514 | 49523833 |
| 13172065 | 19848545 | 47846516 | 49523835 |
| 49523837 | 54779258 | 54780723 | 145910938 |
| 49523841 | 54779260 | 54780731 | 145910942 |
| 49523843 | 54779262 | 54780733 | 145910945 |
| 49523849 | 54779264 | 54780735 | 145910949 |
| 49523851 | 54779266 | 54780741 | 145910952 |
| 49523853 | 54779268 | 54780745 | 145910955 |
| 49523855 | 54779270 | 54780753 | 145910958 |
| 49523861 | 54779272 | 54780757 | 145910966 |
| 49523865 | 54779274 | 54780759 | 145910969 |
| 49523871 | 54779276 | 54780761 | 145910972 |
| 49523873 | 54779278 | 54780763 | 145910975 |
| 49523879 | 54779280 | 54780765 | 145910983 |
| 49523881 | 54779282 | 54780767 | 145910986 |
| 49523887 | 54779284 | 54780771 | 145910989 |
| 49523895 | 54779286 | 54780775 | 145910992 |
| 49523905 | 54779288 | 54780777 | 145910995 |
| 49523919 | 54779290 | 54780779 | 145910998 |
| 49523921 | 54779292 | 54780781 | 145911001 |
| 49523923 | 54779296 | 54780783 | 145911004 |

APPENDIX A-continued

GI NUMBERS OF 3,571 SEQUENCES IN THE HEALTHY PREIMMUNE SET (HPS)

| | | | |
|---|---|---|---|
| 49523927 | 54779298 | 54780785 | 145911013 |
| 49523929 | 54779300 | 54780787 | 145911017 |
| 49523931 | 54779302 | 54780791 | 145911020 |
| 49523946 | 54779306 | 54780793 | 145911023 |
| 49523950 | 54779308 | 54780795 | 145911026 |
| 54779136 | 54779310 | 54780801 | 145911029 |
| 54779140 | 54779314 | 54780803 | 145911032 |
| 54779142 | 54779316 | 54780805 | 145911038 |
| 54779144 | 54779318 | 54780807 | 145911041 |
| 54779146 | 54779320 | 54780809 | 145911044 |
| 54779148 | 54779322 | 54780815 | 145911047 |
| 54779150 | 54779324 | 54780817 | 145911050 |
| 54779152 | 54779328 | 54780821 | 145911053 |
| 54779156 | 54779330 | 54780825 | 145911061 |
| 54779158 | 54779332 | 54780827 | 145911064 |
| 54779160 | 54779334 | 54780831 | 145911072 |
| 54779162 | 54779336 | 54780833 | 145911075 |
| 54779166 | 54779338 | 54780835 | 145911081 |
| 54779168 | 54779340 | 54780837 | 145911086 |
| 54779170 | 54779342 | 54780839 | 145911090 |
| 54779172 | 54779344 | 54780841 | 145911092 |
| 54779174 | 54779350 | 54780843 | 145911096 |
| 54779178 | 54779354 | 54780845 | 145911102 |
| 54779180 | 54779356 | 54780847 | 145911105 |
| 54779182 | 54779358 | 54780853 | 145911108 |
| 54779184 | 54779360 | 54780857 | 145911111 |
| 54779186 | 54779362 | 54780859 | 145911133 |
| 54779188 | 54779364 | 54780861 | 145911150 |
| 54779190 | 54780155 | 54780863 | 145911156 |
| 54779192 | 54780163 | 55228577 | 145911159 |
| 54779194 | 54780167 | 55228579 | 145911162 |
| 54779196 | 54780171 | 55228584 | 145911165 |
| 54779198 | 54780177 | 55228638 | 145911171 |
| 54779200 | 54780179 | 55228640 | 145911174 |
| 54779204 | 54780185 | 55228646 | 145911177 |
| 54779206 | 54780187 | 55228650 | 145911180 |
| 54779208 | 54780191 | 55228651 | 145911183 |
| 54779210 | 54780193 | 55228652 | 145911186 |
| 54779212 | 54780209 | 60688113 | 145911190 |
| 54779214 | 54780211 | 74095346 | 145911193 |
| 54779218 | 54780213 | 74095348 | 145911199 |
| 54779220 | 54780227 | 74095350 | 145911202 |
| 54779222 | 54780229 | 74095355 | 145911205 |
| 54779224 | 54780235 | 74095358 | 145911214 |
| 54779226 | 54780237 | 91979763 | 145911217 |
| 54779228 | 54780239 | 91979789 | 145911220 |
| 54779230 | 54780243 | 91979839 | 145911223 |
| 54779232 | 54780247 | 91979849 | 145911226 |
| 54779234 | 54780251 | 111918091 | 145911235 |
| 54779236 | 54780253 | 111918116 | 145911238 |
| 54779238 | 54780259 | 111918127 | 145911248 |
| 54779240 | 54780709 | 111918184 | 145911257 |
| 54779242 | 54780711 | 111918251 | 145911287 |
| 54779244 | 54780713 | 111918262 | 145911291 |
| 54779248 | 54780715 | 111918647 | 145911294 |
| 54779250 | 54780717 | 121488404 | 145911298 |
| 54779252 | 54780719 | 145910925 | 145911301 |
| 54779256 | 54780721 | 145910934 | 145911305 |
| 145911308 | 145911823 | 145912707 | 145913746 |
| 145911311 | 145911832 | 145912717 | 145913752 |
| 145911314 | 145911840 | 145912725 | 145913757 |
| 145911317 | 145911849 | 145912735 | 145913766 |
| 145911320 | 145911857 | 145912744 | 145913772 |
| 145911323 | 145911883 | 145912753 | 145913777 |
| 145911326 | 145911892 | 145912760 | 145913782 |
| 145911329 | 145911914 | 145912780 | 145913787 |
| 145911332 | 145911936 | 145912790 | 145913792 |
| 145911335 | 145911938 | 145912799 | 145913797 |
| 145911338 | 145911940 | 145912814 | 145913803 |
| 145911341 | 145911942 | 145912824 | 145913808 |
| 145911344 | 145911944 | 145912844 | 145913813 |
| 145911347 | 145911946 | 145912853 | 145913840 |
| 145911350 | 145911948 | 145912861 | 145913852 |
| 145911353 | 145911950 | 145912868 | 145913856 |
| 145911356 | 145911953 | 145912879 | 145913867 |
| 145911359 | 145911959 | 145912888 | 145913875 |
| 145911362 | 145911968 | 145912898 | 145913879 |
| 145911365 | 145911983 | 145912909 | 145913883 |
| 145911368 | 145911992 | 145912919 | 145913888 |
| 145911371 | 145912001 | 145912930 | 145913893 |
| 145911374 | 145912009 | 145912940 | 145913898 |
| 145911377 | 145912023 | 145912949 | 145913902 |
| 145911384 | 145912037 | 145912958 | 145913915 |
| 145911388 | 145912044 | 145912978 | 145913919 |
| 145911391 | 145912059 | 145912996 | 145913921 |
| 145911394 | 145912100 | 145913026 | 145913923 |
| 145911397 | 145912107 | 145913035 | 145913927 |
| 145911400 | 145912114 | 145913042 | 145913929 |
| 145911403 | 145912123 | 145913066 | 145913932 |
| 145911407 | 145912132 | 145913107 | 145913943 |
| 145911410 | 145912152 | 145913138 | 145913955 |
| 145911413 | 145912167 | 145913155 | 145913961 |
| 145911416 | 145912176 | 145913181 | 145913965 |
| 145911421 | 145912186 | 145913209 | 145913969 |
| 145911427 | 145912211 | 145913219 | 145913973 |
| 145911436 | 145912220 | 145913232 | 145913977 |
| 145911442 | 145912229 | 145913236 | 145913980 |
| 145911451 | 145912238 | 145913241 | 145913984 |
| 145911457 | 145912249 | 145913248 | 145913988 |
| 145911466 | 145912260 | 145913257 | 145913991 |
| 145911482 | 145912278 | 145913268 | 145913995 |
| 145911491 | 145912308 | 145913278 | 145914000 |
| 145911498 | 145912353 | 145913288 | 145914004 |
| 145911502 | 145912361 | 145913297 | 145914011 |
| 145911510 | 145912371 | 145913308 | 145914017 |
| 145911517 | 145912381 | 145913344 | 145914020 |
| 145911523 | 145912399 | 145913354 | 145914023 |
| 145911536 | 145912409 | 145913377 | 145914026 |
| 145911544 | 145912418 | 145913386 | 145914038 |
| 145911553 | 145912436 | 145913394 | 145914045 |
| 145911561 | 145912446 | 145913404 | 145914049 |
| 145911568 | 145912456 | 145913415 | 145914056 |
| 145911576 | 145912466 | 145913425 | 145914060 |
| 145911585 | 145912470 | 145913433 | 145914063 |
| 145911597 | 145912479 | 145913470 | 145938277 |
| 145911604 | 145912495 | 145913480 | 145938293 |
| 145911611 | 145912504 | 145913489 | 145938315 |
| 145911618 | 145912508 | 145913518 | 145938332 |
| 145911621 | 145912528 | 145913528 | 145938348 |
| 145911655 | 145912547 | 145913539 | 145938356 |
| 145911663 | 145912566 | 145913549 | 145938362 |
| 145911679 | 145912575 | 145913569 | 145938375 |
| 145911687 | 145912587 | 145913578 | 145938384 |
| 145911695 | 145912589 | 145913588 | 145938391 |
| 145911703 | 145912591 | 145913596 | 145938403 |
| 145911713 | 145912595 | 145913608 | 145938411 |
| 145911722 | 145912598 | 145913620 | 145938421 |
| 145911746 | 145912614 | 145913640 | 145938426 |
| 145911748 | 145912624 | 145913650 | 145938430 |
| 145911750 | 145912635 | 145913660 | 145938438 |
| 145911752 | 145912647 | 145913670 | 145938446 |
| 145911754 | 145912674 | 145913682 | 145938454 |
| 145911768 | 145912682 | 145913687 | 145938462 |
| 145911786 | 145912691 | 145913722 | 145938470 |
| 145911795 | 145912700 | 145913730 | 145938490 |
| 145938504 | 145939392 | 145940316 | 145940902 |
| 145938513 | 145939407 | 145940325 | 145940907 |
| 145938531 | 145939416 | 145940332 | 145940912 |
| 145938537 | 145939432 | 145940340 | 145940917 |
| 145938553 | 145939449 | 145940354 | 145940921 |
| 145938562 | 145939459 | 145940362 | 145940926 |
| 145938570 | 145939470 | 145940370 | 145940940 |
| 145938577 | 145939475 | 145940379 | 145941075 |
| 145938596 | 145939484 | 145940387 | 145941079 |
| 145938621 | 145939501 | 145940399 | 145941083 |
| 145938629 | 145939514 | 145940404 | 145941090 |
| 145938639 | 145939566 | 145940411 | 145941097 |
| 145938647 | 145939578 | 145940416 | 145941111 |
| 145938674 | 145939586 | 145940428 | 145941118 |
| 145938680 | 145939593 | 145940439 | 145941131 |
| 145938689 | 145939602 | 145940441 | 145941134 |
| 145938698 | 145939609 | 145940445 | 145941137 |
| 145938706 | 145939634 | 145940448 | 145941143 |
| 145938713 | 145939643 | 145940450 | 145941151 |

APPENDIX A-continued

GI NUMBERS OF 3,571 SEQUENCES IN THE HEALTHY PREIMMUNE SET (HPS)

| | | | | | | | |
|---|---|---|---|---|---|---|---|
| 145938721 | 145939651 | 145940452 | 145941158 | 145942206 | 159034267 | 159034376 | 159034486 |
| 145938730 | 145939657 | 145940456 | 145941167 | 145942223 | 159034268 | 159034378 | 159034490 |
| 145938737 | 145939670 | 145940461 | 145941176 | 145942261 | 159034273 | 159034379 | 159034492 |
| 145938755 | 145939678 | 145940468 | 145941194 | 145942265 | 159034274 | 159034381 | 159034493 |
| 145938771 | 145939686 | 145940482 | 145941226 | 145942309 | 159034276 | 159034383 | 159034494 |
| 145938808 | 145939694 | 145940489 | 145941231 | 145942383 | 159034277 | 159034384 | 159034495 |
| 145938830 | 145939699 | 145940494 | 145941239 | 145942405 | 159034278 | 159034385 | 159034497 |
| 145938837 | 145939704 | 145940498 | 145941247 | 145942487 | 159034279 | 159034386 | 159034499 |
| 145938865 | 145939707 | 145940508 | 145941255 | 145942497 | 159034280 | 159034387 | 159034500 |
| 145938874 | 145939711 | 145940510 | 145941262 | 145942506 | 159034282 | 159034388 | 159034501 |
| 145938892 | 145939718 | 145940515 | 145941276 | 145942509 | 159034283 | 159034389 | 159034502 |
| 145938899 | 145939724 | 145940520 | 145941296 | 145942544 | 159034284 | 159034390 | 159034503 |
| 145938906 | 145939730 | 145940530 | 145941328 | 145942565 | 159034285 | 159034392 | 159034504 |
| 145938916 | 145939738 | 145940535 | 145941336 | 145942606 | 159034286 | 159034393 | 159034511 |
| 145938926 | 145939747 | 145940541 | 145941349 | 148717962 | 159034287 | 159034395 | 159034512 |
| 145938944 | 145939753 | 145940547 | 145941358 | 148717964 | 159034288 | 159034396 | 159034515 |
| 145938952 | 145939760 | 145940552 | 145941365 | 148717966 | 159034290 | 159034397 | 159034516 |
| 145938969 | 145939766 | 145940557 | 145941373 | 148910865 | 159034291 | 159034398 | 159034518 |
| 145938986 | 145939768 | 145940567 | 145941380 | 159034187 | 159034293 | 159034399 | 159034521 |
| 145938995 | 145939770 | 145940573 | 145941388 | 159034188 | 159034296 | 159034400 | 159034522 |
| 145939005 | 145939776 | 145940583 | 145941393 | 159034189 | 159034297 | 159034402 | 159034523 |
| 145939023 | 145939778 | 145940593 | 145941399 | 159034190 | 159034298 | 159034403 | 159034524 |
| 145939030 | 145939782 | 145940597 | 145941425 | 159034191 | 159034299 | 159034404 | 159034526 |
| 145939044 | 145939788 | 145940602 | 145941459 | 159034192 | 159034300 | 159034405 | 159034527 |
| 145939053 | 145939805 | 145940613 | 145941466 | 159034193 | 159034301 | 159034408 | 159034529 |
| 145939061 | 145939817 | 145940631 | 145941474 | 159034194 | 159034302 | 159034410 | 159034530 |
| 145939069 | 145939824 | 145940636 | 145941483 | 159034195 | 159034303 | 159034414 | 159034531 |
| 145939083 | 145939834 | 145940645 | 145941488 | 159034196 | 159034304 | 159034415 | 159034532 |
| 145939085 | 145939844 | 145940650 | 145941499 | 159034197 | 159034305 | 159034417 | 159034534 |
| 145939087 | 145939858 | 145940656 | 145941505 | 159034198 | 159034306 | 159034419 | 159034535 |
| 145939093 | 145939865 | 145940662 | 145941512 | 159034200 | 159034307 | 159034420 | 159034536 |
| 145939095 | 145939872 | 145940675 | 145941518 | 159034202 | 159034308 | 159034421 | 159034537 |
| 145939097 | 145939879 | 145940681 | 145941539 | 159034203 | 159034309 | 159034422 | 159034538 |
| 145939106 | 145939900 | 145940700 | 145941544 | 159034204 | 159034310 | 159034423 | 159034539 |
| 145939132 | 145939910 | 145940706 | 145941550 | 159034205 | 159034311 | 159034424 | 159034540 |
| 145939147 | 145939921 | 145940711 | 145941558 | 159034207 | 159034313 | 159034425 | 159034541 |
| 145939155 | 145939940 | 145940727 | 145941571 | 159034208 | 159034315 | 159034426 | 159034542 |
| 145939161 | 145939949 | 145940735 | 145941577 | 159034209 | 159034316 | 159034429 | 159034543 |
| 145939169 | 145939970 | 145940742 | 145941588 | 159034211 | 159034318 | 159034430 | 159034545 |
| 145939181 | 145939986 | 145940748 | 145941597 | 159034212 | 159034320 | 159034431 | 159034546 |
| 145939189 | 145940002 | 145940756 | 145941605 | 159034213 | 159034323 | 159034433 | 159034547 |
| 145939197 | 145940029 | 145940762 | 145941634 | 159034214 | 159034324 | 159034434 | 159034549 |
| 145939215 | 145940043 | 145940783 | 145941639 | 159034215 | 159034325 | 159034435 | 159034550 |
| 145939231 | 145940052 | 145940789 | 145941644 | 159034216 | 159034328 | 159034436 | 159034552 |
| 145939237 | 145940070 | 145940797 | 145941650 | 159034217 | 159034329 | 159034438 | 159034554 |
| 145939252 | 145940091 | 145940804 | 145941657 | 159034218 | 159034330 | 159034439 | 159034556 |
| 145939271 | 145940115 | 145940818 | 145941669 | 159034219 | 159034331 | 159034440 | 159034559 |
| 145939285 | 145940124 | 145940825 | 145941674 | 159034222 | 159034335 | 159034441 | 159034562 |
| 145939302 | 145940133 | 145940832 | 145941680 | 159034223 | 159034337 | 159034443 | 159034563 |
| 145939309 | 145940152 | 145940838 | 145941685 | 159034224 | 159034339 | 159034444 | 159034564 |
| 145939317 | 145940167 | 145940846 | 145941698 | 159034225 | 159034340 | 159034445 | 159034565 |
| 145939331 | 145940173 | 145940853 | 145941704 | 159034226 | 159034341 | 159034446 | 159034566 |
| 145939338 | 145940190 | 145940858 | 145941717 | 159034227 | 159034342 | 159034447 | 159034568 |
| 145939346 | 145940218 | 145940865 | 145941724 | 159034228 | 159034343 | 159034448 | 159034570 |
| 145939356 | 145940226 | 145940877 | 145941731 | 159034230 | 159034344 | 159034449 | 159034571 |
| 145939367 | 145940239 | 145940884 | 145941745 | 159034231 | 159034345 | 159034450 | 159034572 |
| 145939384 | 145940269 | 145940891 | 145941752 | 159034233 | 159034346 | 159034451 | 159034573 |
| 145941758 | 159034235 | 159034347 | 159034453 | 159034575 | 159034697 | 159034801 | 159034904 |
| 145941764 | 159034236 | 159034348 | 159034455 | 159034576 | 159034698 | 159034802 | 159034905 |
| 145941791 | 159034238 | 159034349 | 159034460 | 159034578 | 159034699 | 159034804 | 159034906 |
| 145941806 | 159034239 | 159034350 | 159034461 | 159034580 | 159034700 | 159034805 | 159034907 |
| 145941819 | 159034240 | 159034354 | 159034462 | 159034581 | 159034701 | 159034809 | 159034908 |
| 145941822 | 159034241 | 159034355 | 159034463 | 159034582 | 159034704 | 159034811 | 159034909 |
| 145941824 | 159034242 | 159034356 | 159034464 | 159034584 | 159034705 | 159034812 | 159034910 |
| 145941828 | 159034243 | 159034358 | 159034465 | 159034587 | 159034706 | 159034813 | 159034911 |
| 145941837 | 159034244 | 159034359 | 159034466 | 159034588 | 159034708 | 159034815 | 159034912 |
| 145941854 | 159034245 | 159034362 | 159034467 | 159034589 | 159034709 | 159034816 | 159034913 |
| 145941863 | 159034249 | 159034364 | 159034468 | 159034591 | 159034710 | 159034817 | 159034914 |
| 145941877 | 159034250 | 159034365 | 159034471 | 159034596 | 159034711 | 159034818 | 159034917 |
| 145941886 | 159034252 | 159034366 | 159034472 | 159034599 | 159034712 | 159034819 | 159034918 |
| 145941908 | 159034253 | 159034367 | 159034474 | 159034600 | 159034713 | 159034820 | 159034919 |
| 145941915 | 159034254 | 159034368 | 159034476 | 159034601 | 159034714 | 159034821 | 159034920 |
| 145941933 | 159034258 | 159034369 | 159034479 | 159034602 | 159034717 | 159034822 | 159034923 |
| 145942086 | 159034259 | 159034370 | 159034481 | 159034604 | 159034718 | 159034823 | 159034925 |
| 145942146 | 159034260 | 159034372 | 159034482 | 159034607 | 159034720 | 159034824 | 159034926 |
| 145942158 | 159034262 | 159034373 | 159034484 | 159034609 | 159034721 | 159034825 | 159034928 |
| 145942175 | 159034266 | 159034375 | 159034485 | 159034611 | 159034722 | 159034827 | 159034929 |

APPENDIX A-continued

GI NUMBERS OF 3,571 SEQUENCES IN THE
HEALTHY PREIMMUNE SET (HPS)

| | | | |
|---|---|---|---|
| 159034612 | 159034725 | 159034828 | 159034931 |
| 159034613 | 159034726 | 159034829 | 159034934 |
| 159034617 | 159034728 | 159034831 | 159034935 |
| 159034619 | 159034729 | 159034832 | 159034936 |
| 159034620 | 159034730 | 159034833 | 159034937 |
| 159034621 | 159034731 | 159034834 | 159034938 |
| 159034622 | 159034732 | 159034835 | 159034939 |
| 159034625 | 159034733 | 159034837 | 159034940 |
| 159034626 | 159034734 | 159034838 | 159034942 |
| 159034628 | 159034736 | 159034839 | 159034945 |
| 159034629 | 159034737 | 159034840 | 159034946 |
| 159034631 | 159034738 | 159034842 | 159034947 |
| 159034632 | 159034741 | 159034843 | 159034948 |
| 159034634 | 159034742 | 159034844 | 159034950 |
| 159034635 | 159034743 | 159034845 | 159034952 |
| 159034636 | 159034744 | 159034846 | 159034953 |
| 159034637 | 159034745 | 159034847 | 159034954 |
| 159034638 | 159034747 | 159034848 | 159034955 |
| 159034640 | 159034748 | 159034849 | 159034957 |
| 159034641 | 159034749 | 159034852 | 159034959 |
| 159034642 | 159034750 | 159034853 | 159034961 |
| 159034643 | 159034751 | 159034856 | 159034962 |
| 159034647 | 159034752 | 159034858 | 159034963 |
| 159034648 | 159034754 | 159034859 | 159034964 |
| 159034649 | 159034756 | 159034860 | 159034965 |
| 159034650 | 159034758 | 159034861 | 159034967 |
| 159034651 | 159034759 | 159034862 | 159034970 |
| 159034652 | 159034760 | 159034863 | 159034971 |
| 159034653 | 159034762 | 159034864 | 159034973 |
| 159034654 | 159034763 | 159034866 | 159034974 |
| 159034657 | 159034764 | 159034869 | 159034975 |
| 159034658 | 159034765 | 159034871 | 159034976 |
| 159034659 | 159034766 | 159034872 | 159034978 |
| 159034660 | 159034767 | 159034874 | 159034980 |
| 159034661 | 159034768 | 159034876 | 159034981 |
| 159034664 | 159034771 | 159034877 | 159034982 |
| 159034665 | 159034773 | 159034879 | 159034983 |
| 159034668 | 159034774 | 159034880 | 159034984 |
| 159034669 | 159034778 | 159034882 | 159034985 |
| 159034672 | 159034779 | 159034883 | 159034987 |
| 159034673 | 159034780 | 159034885 | 159034988 |
| 159034676 | 159034781 | 159034886 | 159034989 |
| 159034677 | 159034782 | 159034887 | 159034991 |
| 159034678 | 159034783 | 159034888 | 159034992 |
| 159034679 | 159034784 | 159034889 | 159034993 |
| 159034680 | 159034786 | 159034890 | 159034995 |
| 159034681 | 159034787 | 159034892 | 159034996 |
| 159034683 | 159034788 | 159034893 | 159034997 |
| 159034686 | 159034789 | 159034894 | 159034998 |
| 159034687 | 159034790 | 159034895 | 159035002 |
| 159034688 | 159034791 | 159034897 | 159035003 |
| 159034689 | 159034793 | 159034898 | 159035005 |
| 159034690 | 159034794 | 159034899 | 159035007 |
| 159034692 | 159034795 | 159034900 | 159035008 |
| 159034693 | 159034796 | 159034901 | 159035009 |
| 159034695 | 159034798 | 159034902 | 159035010 |
| 159034696 | 159034799 | 159034903 | 159035013 |
| 159035014 | 159035117 | 159035234 | 159035362 |
| 159035015 | 159035118 | 159035235 | 159035363 |
| 159035016 | 159035120 | 159035238 | 159035364 |
| 159035017 | 159035122 | 159035239 | 159035366 |
| 159035018 | 159035123 | 159035240 | 159035368 |
| 159035021 | 159035124 | 159035241 | 159035369 |
| 159035022 | 159035125 | 159035242 | 159035370 |
| 159035023 | 159035126 | 159035245 | 159035372 |
| 159035024 | 159035128 | 159035247 | 159035373 |
| 159035025 | 159035129 | 159035250 | 159035374 |
| 159035026 | 159035130 | 159035253 | 159035378 |
| 159035027 | 159035131 | 159035256 | 159035380 |
| 159035028 | 159035133 | 159035257 | 159035382 |
| 159035031 | 159035134 | 159035260 | 159035384 |
| 159035033 | 159035135 | 159035261 | 159035385 |
| 159035034 | 159035136 | 159035262 | 159035386 |
| 159035035 | 159035137 | 159035263 | 159035390 |
| 159035036 | 159035138 | 159035264 | 159035391 |
| 159035038 | 159035139 | 159035265 | 159035393 |
| 159035039 | 159035140 | 159035267 | 159035394 |
| 159035040 | 159035143 | 159035268 | 159035395 |
| 159035041 | 159035145 | 159035269 | 159035400 |
| 159035042 | 159035146 | 159035270 | 159035401 |
| 159035043 | 159035147 | 159035272 | 159035402 |
| 159035044 | 159035149 | 159035273 | 159035403 |
| 159035045 | 159035150 | 159035274 | 159035404 |
| 159035046 | 159035151 | 159035275 | 159035405 |
| 159035047 | 159035152 | 159035277 | 159035406 |
| 159035049 | 159035155 | 159035279 | 159035407 |
| 159035050 | 159035158 | 159035280 | 159035408 |
| 159035051 | 159035159 | 159035282 | 159035413 |
| 159035052 | 159035160 | 159035284 | 159035418 |
| 159035053 | 159035162 | 159035285 | 159035420 |
| 159035054 | 159035163 | 159035287 | 159035422 |
| 159035055 | 159035164 | 159035288 | 159035423 |
| 159035056 | 159035166 | 159035289 | 159035424 |
| 159035057 | 159035170 | 159035290 | 159035425 |
| 159035058 | 159035172 | 159035292 | 159035426 |
| 159035060 | 159035173 | 159035293 | 159035427 |
| 159035061 | 159035174 | 159035294 | 159035430 |
| 159035063 | 159035175 | 159035296 | 159035432 |
| 159035064 | 159035176 | 159035299 | 159035433 |
| 159035065 | 159035177 | 159035302 | 159035435 |
| 159035066 | 159035179 | 159035303 | 159035436 |
| 159035067 | 159035180 | 159035305 | 159035437 |
| 159035072 | 159035181 | 159035307 | 159035439 |
| 159035073 | 159035182 | 159035308 | 159035441 |
| 159035074 | 159035183 | 159035309 | 159035445 |
| 159035075 | 159035185 | 159035310 | 159035446 |
| 159035076 | 159035186 | 159035312 | 159035447 |
| 159035079 | 159035187 | 159035313 | 159035449 |
| 159035080 | 159035188 | 159035314 | 159035450 |
| 159035081 | 159035191 | 159035315 | 159035451 |
| 159035083 | 159035192 | 159035316 | 159035452 |
| 159035084 | 159035193 | 159035318 | 159035453 |
| 159035085 | 159035194 | 159035319 | 159035454 |
| 159035086 | 159035195 | 159035320 | 159035456 |
| 159035087 | 159035199 | 159035321 | 159035457 |
| 159035089 | 159035201 | 159035323 | 159035458 |
| 159035090 | 159035204 | 159035327 | 159035459 |
| 159035092 | 159035205 | 159035329 | 159035461 |
| 159035097 | 159035206 | 159035330 | 159035463 |
| 159035100 | 159035207 | 159035331 | 159035464 |
| 159035101 | 159035208 | 159035334 | 159035466 |
| 159035102 | 159035209 | 159035335 | 159035468 |
| 159035103 | 159035210 | 159035338 | 159035470 |
| 159035104 | 159035211 | 159035342 | 159035472 |
| 159035106 | 159035212 | 159035343 | 159035473 |
| 159035108 | 159035213 | 159035344 | 159035475 |
| 159035109 | 159035215 | 159035346 | 159035476 |
| 159035110 | 159035218 | 159035348 | 159035477 |
| 159035111 | 159035221 | 159035349 | 159035479 |
| 159035112 | 159035224 | 159035350 | 159035483 |
| 159035113 | 159035226 | 159035351 | 159035484 |
| 159035114 | 159035227 | 159035353 | 159035490 |
| 159035115 | 159035230 | 159035360 | 159035492 |
| 159035116 | 159035232 | 159035361 | 159035493 |
| 159035496 | 159035605 | 162950148 | 162950323 |
| 159035497 | 159035609 | 162950152 | 162950325 |
| 159035498 | 159035610 | 162950188 | 162950326 |
| 159035499 | 159035611 | 162950189 | 162950327 |
| 159035501 | 159035612 | 162950191 | 162950328 |
| 159035502 | 159035614 | 162950199 | 162950329 |
| 159035503 | 159035618 | 162950202 | 162950330 |
| 159035507 | 159035619 | 162950204 | 162950333 |
| 159035508 | 159035624 | 162950205 | 162950334 |
| 159035512 | 159035626 | 162950210 | 162950335 |
| 159035513 | 159035627 | 162950211 | 162950337 |
| 159035514 | 159035628 | 162950213 | 162950338 |
| 159035515 | 159035630 | 162950227 | 162950339 |
| 159035516 | 159035631 | 162950241 | 162950341 |
| 159035519 | 159035632 | 162950243 | 162950342 |
| 159035520 | 159035633 | 162950244 | 162950343 |
| 159035523 | 159035634 | 162950245 | 162950344 |
| 159035524 | 159035636 | 162950248 | 162950345 |
| 159035525 | 159035637 | 162950249 | 162950347 |
| 159035526 | 159035638 | 162950250 | 162950348 |

APPENDIX A-continued

GI NUMBERS OF 3,571 SEQUENCES IN THE HEALTHY PREIMMUNE SET (HPS)

| | | | |
|---|---|---|---|
| 159035527 | 159035640 | 162950251 | 162950350 |
| 159035528 | 159035641 | 162950252 | 162950352 |
| 159035529 | 159035642 | 162950253 | 162950353 |
| 159035531 | 159035644 | 162950254 | 162950355 |
| 159035532 | 159035646 | 162950255 | 162950359 |
| 159035533 | 159035649 | 162950257 | 162950360 |
| 159035535 | 159035650 | 162950258 | 162950361 |
| 159035536 | 159035653 | 162950260 | 162950363 |
| 159035537 | 159035655 | 162950261 | 162950365 |
| 159035538 | 159035656 | 162950263 | 162950367 |
| 159035541 | 159035658 | 162950265 | 162950369 |
| 159035542 | 159035659 | 162950266 | 162950372 |
| 159035546 | 159035661 | 162950267 | 162950373 |
| 159035548 | 159035662 | 162950269 | 162950374 |
| 159035549 | 159035663 | 162950270 | 162950375 |
| 159035550 | 159035664 | 162950272 | 162950377 |
| 159035552 | 162950025 | 162950273 | 162950381 |
| 159035553 | 162950028 | 162950275 | 162950382 |
| 159035554 | 162950034 | 162950277 | 162950384 |
| 159035556 | 162950035 | 162950278 | 162950385 |
| 159035557 | 162950039 | 162950279 | 162950386 |
| 159035559 | 162950043 | 162950282 | 162950387 |
| 159035560 | 162950050 | 162950284 | 162950388 |
| 159035562 | 162950051 | 162950285 | 162950390 |
| 159035563 | 162950052 | 162950286 | 162950391 |
| 159035564 | 162950054 | 162950287 | 162950392 |
| 159035565 | 162950055 | 162950288 | 162950393 |
| 159035566 | 162950057 | 162950289 | 162950394 |
| 159035567 | 162950065 | 162950290 | 162950396 |
| 159035568 | 162950067 | 162950291 | 162950397 |
| 159035569 | 162950077 | 162950292 | 162950398 |
| 159035570 | 162950097 | 162950293 | 162950399 |
| 159035571 | 162950098 | 162950294 | 162950400 |
| 159035573 | 162950100 | 162950295 | 162950401 |
| 159035574 | 162950111 | 162950296 | 162950404 |
| 159035575 | 162950114 | 162950297 | 162950405 |
| 159035576 | 162950115 | 162950298 | 162950406 |
| 159035577 | 162950120 | 162950299 | 162950408 |
| 159035581 | 162950121 | 162950300 | 162950410 |
| 159035582 | 162950123 | 162950301 | 162950411 |
| 159035583 | 162950125 | 162950302 | 162950416 |
| 159035584 | 162950126 | 162950303 | 162950418 |
| 159035585 | 162950127 | 162950305 | 162950419 |
| 159035586 | 162950128 | 162950306 | 162950420 |
| 159035589 | 162950129 | 162950308 | 162950421 |
| 159035590 | 162950130 | 162950309 | 162950423 |
| 159035591 | 162950132 | 162950310 | 162950425 |
| 159035592 | 162950133 | 162950311 | 162950426 |
| 159035593 | 162950134 | 162950312 | 162950428 |
| 159035594 | 162950137 | 162950313 | 162950430 |
| 159035595 | 162950138 | 162950314 | 162950431 |
| 159035596 | 162950139 | 162950315 | 162950432 |
| 159035597 | 162950140 | 162950316 | 162950433 |
| 159035598 | 162950141 | 162950317 | 162950434 |
| 159035602 | 162950143 | 162950318 | 162950435 |
| 159035603 | 162950146 | 162950319 | 162950437 |
| 159035604 | 162950147 | 162950321 | 162950438 |
| 162950439 | 162950566 | 162950674 | |
| 162950440 | 162950568 | 162950675 | |
| 162950441 | 162950570 | 162950676 | |
| 162950442 | 162950571 | 162950685 | |
| 162950444 | 162950572 | 162950686 | |
| 162950445 | 162950573 | 162950688 | |
| 162950446 | 162950574 | 162950689 | |
| 162950447 | 162950575 | 162950691 | |
| 162950449 | 162950577 | 162950692 | |
| 162950450 | 162950578 | 162950693 | |
| 162950451 | 162950579 | 162950694 | |
| 162950453 | 162950580 | 162950695 | |
| 162950454 | 162950581 | 162950696 | |
| 162950456 | 162950582 | 162950697 | |
| 162950461 | 162950583 | 162950698 | |
| 162950463 | 162950584 | 162950710 | |
| 162950464 | 162950585 | 162950714 | |
| 162950465 | 162950586 | 162950716 | |
| 162950466 | 162950587 | 162950720 | |
| 162950467 | 162950589 | 162950724 | |
| 162950469 | 162950590 | 162950725 | |
| 162950470 | 162950591 | 162950726 | |
| 162950471 | 162950592 | 162950728 | |
| 162950474 | 162950593 | 162950729 | |
| 162950476 | 162950594 | 194719560 | |
| 162950481 | 162950596 | 194719575 | |
| 162950483 | 162950597 | 218454113 | |
| 162950484 | 162950598 | 218454117 | |
| 162950485 | 162950599 | 219937557 | |
| 162950487 | 162950600 | | |
| 162950489 | 162950602 | | |
| 162950490 | 162950604 | | |
| 162950491 | 162950605 | | |
| 162950492 | 162950606 | | |
| 162950493 | 162950609 | | |
| 162950494 | 162950610 | | |
| 162950496 | 162950611 | | |
| 162950498 | 162950613 | | |
| 162950500 | 162950614 | | |
| 162950503 | 162950615 | | |
| 162950504 | 162950617 | | |
| 162950514 | 162950618 | | |
| 162950515 | 162950619 | | |
| 162950516 | 162950620 | | |
| 162950517 | 162950621 | | |
| 162950518 | 162950622 | | |
| 162950519 | 162950626 | | |
| 162950520 | 162950627 | | |
| 162950522 | 162950628 | | |
| 162950525 | 162950629 | | |
| 162950526 | 162950631 | | |
| 162950527 | 162950632 | | |
| 162950528 | 162950633 | | |
| 162950529 | 162950634 | | |
| 162950530 | 162950635 | | |
| 162950531 | 162950640 | | |
| 162950532 | 162950641 | | |
| 162950534 | 162950642 | | |
| 162950535 | 162950644 | | |
| 162950536 | 162950645 | | |
| 162950537 | 162950646 | | |
| 162950539 | 162950647 | | |
| 162950540 | 162950649 | | |
| 162950542 | 162950650 | | |
| 162950543 | 162950651 | | |
| 162950546 | 162950652 | | |
| 162950547 | 162950654 | | |
| 162950551 | 162950655 | | |
| 162950552 | 162950656 | | |
| 162950555 | 162950659 | | |
| 162950556 | 162950660 | | |
| 162950557 | 162950661 | | |
| 162950558 | 162950662 | | |
| 162950559 | 162950665 | | |
| 162950562 | 162950666 | | |
| 162950564 | 162950671 | | |
| 162950565 | 162950673 | | |

SEQUENCE LISTING (8764 sequences)

SEQ ID NO: 1 - protein, 8 aa, Homo sapiens
QQYNSYST

SEQ ID NO: 2 - protein, 8 aa, Homo sapiens
QQYNSYFT

SEQ ID NO: 3 - protein, 8 aa, Homo sapiens
QQYNSYLT

SEQ ID NO: 4 - protein, 8 aa, Homo sapiens
QQYNSYIT

SEQ ID NO: 5 - protein, 8 aa, Homo sapiens
QQYNSYRT

SEQ ID NO: 6 - protein, 8 aa, Homo sapiens
QQYNSYWT

SEQ ID NO: 7 - protein, 8 aa, Homo sapiens
QQYNSYYT

SEQ ID NO: 8 - protein, 9 aa, Homo sapiens
QQYNSYSPT

SEQ ID NO: 9 - protein, 9 aa, Homo sapiens
QQYNSYSFT

SEQ ID NO: 10 - protein, 9 aa, Homo sapiens
QQYNSYSLT

SEQ ID NO: 11 - protein, 9 aa, Homo sapiens
QQYNSYSIT

SEQ ID NO: 12 - protein, 9 aa, Homo sapiens
QQYNSYSRT

SEQ ID NO: 13 - protein, 9 aa, Homo sapiens
QQYNSYSWT

SEQ ID NO: 14 - protein, 9 aa, Homo sapiens
QQYNSYSYT

SEQ ID NO: 15 - protein, 10 aa, Homo sapiens
QQYNSYSPFT

SEQ ID NO: 16 - protein, 10 aa, Homo sapiens
QQYNSYSPLT

SEQ ID NO: 17 - protein, 10 aa, Homo sapiens
QQYNSYSPIT

SEQ ID NO: 18 - protein, 10 aa, Homo sapiens
QQYNSYSPRT

SEQ ID NO: 19 - protein, 10 aa, Homo sapiens
QQYNSYSPWT

SEQ ID NO: 20 - protein, 10 aa, Homo sapiens
QQYNSYSPYT

SEQ ID NO: 21 - protein, 8 aa, Homo sapiens
QQANSFPT

SEQ ID NO: 22 - protein, 8 aa, Homo sapiens
QQANSFFT

SEQ ID NO: 23 - protein, 8 aa, Homo sapiens
QQANSFLT

SEQ ID NO: 24 - protein, 8 aa, Homo sapiens
QQANSFIT

SEQ ID NO: 25 - protein, 8 aa, Homo sapiens
QQANSFRT

SEQ ID NO: 26 - protein, 8 aa, Homo sapiens
QQANSFWT

SEQ ID NO: 27 - protein, 8 aa, Homo sapiens
QQANSFYT

SEQ ID NO: 28 - protein, 9 aa, Homo sapiens
QQANSFPPT

SEQ ID NO: 29 - protein, 9 aa, Homo sapiens
QQANSFPFT

SEQ ID NO: 30 - protein, 9 aa, Homo sapiens
QQANSFPLT

SEQ ID NO: 31 - protein, 9 aa, Homo sapiens
QQANSFPIT

SEQ ID NO: 32 - protein, 9 aa, Homo sapiens
QQANSFPRT

SEQ ID NO: 33 - protein, 9 aa, Homo sapiens
QQANSFPWT

SEQ ID NO: 34 - protein, 9 aa, Homo sapiens
QQANSFPYT

SEQ ID NO: 35 - protein, 10 aa, Homo sapiens
QQANSFPPFT

SEQ ID NO: 36 - protein, 10 aa, Homo sapiens
QQANSFPPLT

SEQ ID NO: 37 - protein, 10 aa, Homo sapiens
QQANSFPPIT

SEQ ID NO: 38 - protein, 10 aa, Homo sapiens
QQANSFPPRT

SEQ ID NO: 39 - protein, 10 aa, Homo sapiens
QQANSFPPWT

SEQ ID NO: 40 - protein, 10 aa, Homo sapiens
QQANSFPPYT

SEQ ID NO: 41 - protein, 8 aa, Homo sapiens
QQYDNLPT

SEQ ID NO: 42 - protein, 8 aa, Homo sapiens
QQYDNLFT

SEQ ID NO: 43 - protein, 8 aa, Homo sapiens
QQYDNLLT

SEQ ID NO: 44 - protein, 8 aa, Homo sapiens
QQYDNLIT

SEQ ID NO: 45 - protein, 8 aa, Homo sapiens
QQYDNLRT

SEQ ID NO: 46 - protein, 8 aa, Homo sapiens
QQYDNLWT

SEQ ID NO: 47 - protein, 8 aa, Homo sapiens
QQYDNLYT

SEQ ID NO: 48 - protein, 9 aa, Homo sapiens
QQYDNLPPT

SEQ ID NO: 49 - protein, 9 aa, Homo sapiens
QQYDNLPFT

SEQ ID NO: 50 - protein, 9 aa, Homo sapiens
QQYDNLPLT

SEQ ID NO: 51 - protein, 9 aa, Homo sapiens
QQYDNLPIT

SEQ ID NO: 52 - protein, 9 aa, Homo sapiens
QQYDNLPRT

SEQ ID NO: 53 - protein, 9 aa, Homo sapiens
QQYDNLPWT

SEQ ID NO: 54 - protein, 9 aa, Homo sapiens
QQYDNLPYT

SEQ ID NO: 55 - protein, 10 aa, Homo sapiens
QQYDNLPPFT

SEQ ID NO: 56 - protein, 10 aa, Homo sapiens
QQYDNLPPLT

SEQ ID NO: 57 - protein, 10 aa, Homo sapiens
QQYDNLPPIT

SEQ ID NO: 58 - protein, 10 aa, Homo sapiens
QQYDNLPPRT

SEQ ID NO: 59 - protein, 10 aa, Homo sapiens
QQYDNLPPWT

SEQ ID NO: 60 - protein, 10 aa, Homo sapiens
QQYDNLPPYT

SEQ ID NO: 61 - protein, 8 aa, Homo sapiens
QQSYSTPT

SEQ ID NO: 62 - protein, 8 aa, Homo sapiens
QQSYSTFT

SEQ ID NO: 63 - protein, 8 aa, Homo sapiens
QQSYSTLT

SEQ ID NO: 64 - protein, 8 aa, Homo sapiens
QQSYSTIT

SEQ ID NO: 65 - protein, 8 aa, Homo sapiens
QQSYSTRT

SEQ ID NO: 66 - protein, 8 aa, Homo sapiens
QQSYSTWT

SEQ ID NO: 67 - protein, 8 aa, Homo sapiens
QQSYSTYT

SEQ ID NO: 68 - protein, 9 aa, Homo sapiens
QQSYSTPPT

SEQ ID NO: 69 - protein, 9 aa, Homo sapiens
QQSYSTPFT

SEQ ID NO: 70 - protein, 9 aa, Homo sapiens
QQSYSTPLT

SEQ ID NO: 71 - protein, 9 aa, Homo sapiens
QQSYSTPIT

SEQ ID NO: 72 - protein, 9 aa, Homo sapiens
QQSYSTPRT

SEQ ID NO: 73 - protein, 9 aa, Homo sapiens
QQSYSTPWT

SEQ ID NO: 74 - protein, 9 aa, Homo sapiens
QQSYSTPYT

SEQ ID NO: 75 - protein, 10 aa, Homo sapiens
QQSYSTPPFT

SEQ ID NO: 76 - protein, 10 aa, Homo sapiens
QQSYSTPPLT

SEQ ID NO: 77 - protein, 10 aa, Homo sapiens
QQSYSTPPIT

SEQ ID NO: 78 - protein, 10 aa, Homo sapiens
QQSYSTPPRT

SEQ ID NO: 79 - protein, 10 aa, Homo sapiens
QQSYSTPPWT

SEQ ID NO: 80 - protein, 10 aa, Homo sapiens
QQSYSTPPYT

SEQ ID NO: 81 - protein, 8 aa, Homo sapiens
QQYYSTPT

SEQ ID NO: 82 - protein, 8 aa, Homo sapiens
QQYYSTFT

SEQ ID NO: 83 - protein, 8 aa, Homo sapiens
QQYYSTLT

SEQ ID NO: 84 - protein, 8 aa, Homo sapiens
QQYYSTIT

SEQ ID NO: 85 - protein, 8 aa, Homo sapiens
QQYYSTRT

SEQ ID NO: 86 - protein, 8 aa, Homo sapiens
QQYYSTWT

SEQ ID NO: 87 - protein, 8 aa, Homo sapiens
QQYYSTYT

SEQ ID NO: 88 - protein, 9 aa, Homo sapiens
QQYYSTPPT

SEQ ID NO: 89 - protein, 9 aa, Homo sapiens
QQYYSTPFT

SEQ ID NO: 90 - protein, 9 aa, Homo sapiens
QQYYSTPLT

SEQ ID NO: 91 - protein, 9 aa, Homo sapiens
QQYYSTPIT

SEQ ID NO: 92 - protein, 9 aa, Homo sapiens
QQYYSTPRT

SEQ ID NO: 93 - protein, 9 aa, Homo sapiens
QQYYSTPWT

SEQ ID NO: 94 - protein, 9 aa, Homo sapiens
QQYYSTPYT

SEQ ID NO: 95 - protein, 10 aa, Homo sapiens
QQYYSTPPFT

SEQ ID NO: 96 - protein, 10 aa, Homo sapiens
QQYYSTPPLT

SEQ ID NO: 97 - protein, 10 aa, Homo sapiens
QQYYSTPPIT

SEQ ID NO: 98 - protein, 10 aa, Homo sapiens
QQYYSTPPRT

SEQ ID NO: 99 - protein, 10 aa, Homo sapiens
QQYYSTPPWT

SEQ ID NO: 100 - protein, 10 aa, Homo sapiens
QQYYSTPPYT

SEQ ID NO: 101 - protein, 8 aa, Homo sapiens
MQALQTPT

SEQ ID NO: 102 - protein, 8 aa, Homo sapiens
MQALQTFT

SEQ ID NO: 103 - protein, 8 aa, Homo sapiens
MQALQTLT

SEQ ID NO: 104 - protein, 8 aa, Homo sapiens
MQALQTIT

SEQ ID NO: 105 - protein, 8 aa, Homo sapiens
MQALQTRT

SEQ ID NO: 106 - protein, 8 aa, Homo sapiens
MQALQTWT

SEQ ID NO: 107 - protein, 8 aa, Homo sapiens
MQALQTYT

SEQ ID NO: 108 - protein, 9 aa, Homo sapiens
MQALQTPPT

SEQ ID NO: 109 - protein, 9 aa, Homo sapiens
MQALQTPFT

SEQ ID NO: 110 - protein, 9 aa, Homo sapiens
MQALQTPLT

SEQ ID NO: 111 - protein, 9 aa, Homo sapiens
MQALQTPIT

SEQ ID NO: 112 - protein, 9 aa, Homo sapiens
MQALQTPRT

SEQ ID NO: 113 - protein, 9 aa, Homo sapiens
MQALQTPWT

SEQ ID NO: 114 - protein, 9 aa, Homo sapiens
MQALQTPYT

SEQ ID NO: 115 - protein, 10 aa, Homo sapiens
MQALQTPPFT

SEQ ID NO: 116 - protein, 10 aa, Homo sapiens
MQALQTPPLT

SEQ ID NO: 117 - protein, 10 aa, Homo sapiens
MQALQTPPIT

SEQ ID NO: 118 - protein, 10 aa, Homo sapiens
MQALQTPPRT

SEQ ID NO: 119 - protein, 10 aa, Homo sapiens
MQALQTPPWT

SEQ ID NO: 120 - protein, 10 aa, Homo sapiens
MQALQTPPYT

SEQ ID NO: 121 - protein, 8 aa, Homo sapiens
QQRSNWPT

SEQ ID NO: 122 - protein, 8 aa, Homo sapiens
QQRSNWFT

SEQ ID NO: 123 - protein, 8 aa, Homo sapiens
QQRSNWLT

SEQ ID NO: 124 - protein, 8 aa, Homo sapiens
QQRSNWIT

SEQ ID NO: 125 - protein, 8 aa, Homo sapiens
QQRSNWRT

SEQ ID NO: 126 - protein, 8 aa, Homo sapiens
QQRSNWWT

SEQ ID NO: 127 - protein, 8 aa, Homo sapiens
QQRSNWYT

SEQ ID NO: 128 - protein, 9 aa, Homo sapiens
QQRSNWPPT

SEQ ID NO: 129 - protein, 9 aa, Homo sapiens
QQRSNWPFT

SEQ ID NO: 130 - protein, 9 aa, Homo sapiens
QQRSNWPLT

SEQ ID NO: 131 - protein, 9 aa, Homo sapiens
QQRSNWPIT

SEQ ID NO: 132 - protein, 9 aa, Homo sapiens
QQRSNWPRT

SEQ ID NO: 133 - protein, 9 aa, Homo sapiens
QQRSNWPWT

SEQ ID NO: 134 - protein, 9 aa, Homo sapiens
QQRSNWPYT

SEQ ID NO: 135 - protein, 10 aa, Homo sapiens
QQRSNWPPFT

SEQ ID NO: 136 - protein, 10 aa, Homo sapiens
QQRSNWPPLT

SEQ ID NO: 137 - protein, 10 aa, Homo sapiens
QQRSNWPPIT

SEQ ID NO: 138 - protein, 10 aa, Homo sapiens
QQRSNWPPRT

SEQ ID NO: 139 - protein, 10 aa, Homo sapiens
QQRSNWPPWT

SEQ ID NO: 140 - protein, 10 aa, Homo sapiens
QQRSNWPPYT

SEQ ID NO: 141 - protein, 8 aa, Homo sapiens
QQYNNWPT

SEQ ID NO: 142 - protein, 8 aa, Homo sapiens
QQYNNWFT

SEQ ID NO: 143 - protein, 8 aa, Homo sapiens
QQYNNWLT

SEQ ID NO: 144 - protein, 8 aa, Homo sapiens
QQYNNWIT

SEQ ID NO: 145 - protein, 8 aa, Homo sapiens
QQYNNWRT

SEQ ID NO: 146 - protein, 8 aa, Homo sapiens
QQYNNWWT

SEQ ID NO: 147 - protein, 8 aa, Homo sapiens
QQYNNWYT

SEQ ID NO: 148 - protein, 9 aa, Homo sapiens
QQYNNWPPT

SEQ ID NO: 149 - protein, 9 aa, Homo sapiens
QQYNNWPFT

SEQ ID NO: 150 - protein, 9 aa, Homo sapiens
QQYNNWPLT

SEQ ID NO: 151 - protein, 9 aa, Homo sapiens
QQYNNWPIT

SEQ ID NO: 152 - protein, 9 aa, Homo sapiens
QQYNNWPRT

SEQ ID NO: 153 - protein, 9 aa, Homo sapiens
QQYNNWPWT

SEQ ID NO: 154 - protein, 9 aa, Homo sapiens
QQYNNWPYT

SEQ ID NO: 155 - protein, 10 aa, Homo sapiens
QQYNNWPPFT

SEQ ID NO: 156 - protein, 10 aa, Homo sapiens
QQYNNWPPLT

SEQ ID NO: 157 - protein, 10 aa, Homo sapiens
QQYNNWPPIT

SEQ ID NO: 158 - protein, 10 aa, Homo sapiens
QQYNNWPPRT

SEQ ID NO: 159 - protein, 10 aa, Homo sapiens [sequence omitted]

SEQ ID NO: 160 - protein, 10 aa, Homo sapiens
QQYNNWPPYT

SEQ ID NO: 161 - protein, 8 aa, Homo sapiens
QQYGSSPT

SEQ ID NO: 162 - protein, 8 aa, Homo sapiens
QQYGSSFT

SEQ ID NO: 163 - protein, 8 aa, Homo sapiens
QQYGSSLT

SEQ ID NO: 164 - protein, 8 aa, Homo sapiens
QQYGSSIT

SEQ ID NO: 165 - protein, 8 aa, Homo sapiens
QQYGSSRT

SEQ ID NO: 166 - protein, 8 aa, Homo sapiens
QQYGSSWT

SEQ ID NO: 167 - protein, 8 aa, Homo sapiens
QQYGSSYT

SEQ ID NO: 168 - protein, 9 aa, Homo sapiens
QQYGSSPPT

SEQ ID NO: 169 - protein, 9 aa, Homo sapiens
QQYGSSPFT

SEQ ID NO: 170 - protein, 9 aa, Homo sapiens
QQYGSSPLT

SEQ ID NO: 171 - protein, 9 aa, Homo sapiens
QQYGSSPIT

SEQ ID NO: 172 - protein, 9 aa, Homo sapiens
QQYGSSPRT

SEQ ID NO: 173 - protein, 9 aa, Homo sapiens
QQYGSSPWT

SEQ ID NO: 174 - protein, 9 aa, Homo sapiens
QQYGSSPYT

SEQ ID NO: 175 - protein, 10 aa, Homo sapiens
QQYGSSPPFT

SEQ ID NO: 176 - protein, 10 aa, Homo sapiens
QQYGSSPPLT

SEQ ID NO: 177 - protein, 10 aa, Homo sapiens
QQYGSSPPIT

SEQ ID NO: 178 - protein, 10 aa, Homo sapiens
QQYGSSPPRT

SEQ ID NO: 179 - protein, 10 aa, Homo sapiens
QQYGSSPPWT

SEQ ID NO: 180 - protein, 10 aa, Homo sapiens
QQYGSSPPYT

SEQ ID NO: 181 - protein, 88 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYC

SEQ ID NO: 182 - protein, 88 aa, Homo sapiens
DIQMTQSPSSLSASVGDRVTITCRASQSINSYLNWYQQKPGKAPKLLIYAASSLQSGVPSRFSGSGSGTDFTLTISSLQPEDFATYYC

SEQ ID NO: 183 - protein, 88 aa, Homo sapiens
DIQMTQSPSSLSASVGDRVTITCRASQSIDSYLNWYQQKPGKAPKLLIYAASSLQSGVPSRFSGSGSGTDFTLTISSLQPEDFATYYC

SEQ ID NO: 184 - protein, 88 aa, Homo sapiens
DIQMTQSPSSLSASVGDRVTITCRASQSISRYLNWYQQKPGKAPKLLIYAASSLQSGVPSRFSGSGSGTDFTLTISSLQPEDFATYYC

SEQ ID NO: 185 - protein, 88 aa, Homo sapiens
DIQMTQSPSSLSASVGDRVTITCRASQSISSYLNWYQQKPGKAPKLLIYGASSLQSGVPSRFSGSGSGTDFTLTISSLQPEDFATYYC

SEQ ID NO: 186 - protein, 88 aa, Homo sapiens
DIQMTQSPSSLSASVGDRVTITCRASQSISSYLNWYQQKPGKAPKLLIYSASSLQSGVPSRFSGSGSGTDFTLTISSLQPEDFATYYC

SEQ ID NO: 187 - protein, 88 aa, Homo sapiens
DIQMTQSPSSLSASVGDRVTITCRASQSISSYLNWYQQKPGKAPKLLIYAASNLQSGVPSRFSGSGSGTDFTLTISSLQPEDFATYYC

SEQ ID NO: 188 - protein, 88 aa, Homo sapiens
DIQLTQSPSSLSASVGDRVTITCRASQSISSYLNWYQQKPGKAPKLLIYAASSLQSGVPSRFSGSGSGTDFTLTISSLQPEDFATYYC

SEQ ID NO: 189 - protein, 88 aa, Homo sapiens
DIQLTQSPSSLSASVGDRVTITCRASQSINSYLNWYQQKPGKAPKLLIYAASSLQSGVPSRFSGSGSGTDFTLTISSLQPEDFATYYC

SEQ ID NO: 190 - protein, 88 aa, Homo sapiens
DIQLTQSPSSLSASVGDRVTITCRASQSIDSYLNWYQQKPGKAPKLLIYAASSLQSGVPSRFSGSGSGTDFTLTISSLQPEDFATYYC

SEQ ID NO: 191 - protein, 88 aa, Homo sapiens
DIQLTQSPSSLSASVGDRVTITCRASQSISSFLNWYQQKPGKAPKLLIYAASSLQSGVPSRFSGSGSGTDFTLTISSLQPEDFATYYC

SEQ ID NO: 192 - protein, 88 aa, Homo sapiens
DIQLTQSPSSLSASVGDRVTITCRASQSISSYLNWYQQKPGKAPKLLIYSASSLQSGVPSRFSGSGSGTDFTLTISSLQPEDFATYYC

SEQ ID NO: 193 - protein, 88 aa, Homo sapiens
DIQLTQSPSSLSASVGDRVTITCRASQSISSYLNWYQQKPGKAPKLLIYAASNLQSGVPSRFSGSGSGTDFTLTISSLQPEDFATYYC

SEQ ID NO: 194 - protein, 88 aa, Homo sapiens
DIQMTQSPSSLSASVGDRVTITCRASQSISSYLNWYQQKPGKAPKLLISAASSLQSGVPSRFSGSGSGTDFTLTISSLQPEDFATYYC

SEQ ID NO: 195 - protein, 88 aa, Homo sapiens
DIQMTQSPSSLSASVGDRVTITCRASQSISRYLNWYQQKPGKAPKLLISAASSLQSGVPSRFSGSGSGTDFTLTISSLQPEDFATYYC

SEQ ID NO: 196 - protein, 88 aa, Homo sapiens
DIQMTQSPSSLSASVGDRVTITCRASQSISIYLNWYQQKPGKAPKLLISAASSLQSGVPSRFSGSGSGTDFTLTISSLQPEDFATYYC

SEQ ID NO: 197 - protein, 88 aa, Homo sapiens
DIQMTQSPSSLSASVGDRVTITCRASQSISSFLNWYQQKPGKAPKLLISAASSLQSGVPSRFSGSGSGTDFTLTISSLQPEDFATYYC

SEQ ID NO: 198 - protein, 88 aa, Homo sapiens
DIQMTQSPSTLSASVGDRVTITCRASQSISSWLAWYQQKPGKAPKLLIYDASSLESGVPSRFSGSGSGTEFTLTISSLQPDDFATYYC

SEQ ID NO: 199 - protein, 88 aa, Homo sapiens
DIQMTQSPSTLSASVGDRVTITCRASQGISSWLAWYQQKPGKAPKLLIYDASSLESGVPSRFSGSGSGTEFTLTISSLQPDDFATYYC

SEQ ID NO: 200 - protein, 88 aa, Homo sapiens
DIQMTQSPSTLSASVGDRVTITCRASQSISSWLAWYQQKPGKAPKLLIYEASSLESGVPSRFSGSGSGTEFTLTISSLQPDDFATYYC

SEQ ID NO: 201 - protein, 88 aa, Homo sapiens
DIQMTQSPSTLSASVGDRVTITCRASQSISSWLAWYQQKPGKAPKLLIYKASSLESGVPSRFSGSGSGTEFTLTISSLQPDDFATYYC

SEQ ID NO: 202 - protein, 88 aa, Homo sapiens
DIQMTQSPSTLSASVGDRVTITCRASQAISSWLAWYQQKPGKAPKLLIYKASSLESGVPSRFSGSGSGTEFTLTISSLQPDDFATYYC

SEQ ID NO: 203 - protein, 88 aa, Homo sapiens
DIQMTQSPSTLSASVGDRVTITCRASQSINSWLAWYQQKPGKAPKLLIYKASSLESGVPSRFSGSGSGTEFTLTISSLQPDDFATYYC

SEQ ID NO: 204 - protein, 88 aa, Homo sapiens
DIQMTQSPSTLSASVGDRVTITCRASQSIGSWLAWYQQKPGKAPKLLIYKASSLESGVPSRFSGSGSGTEFTLTISSLQPDDFATYYC

SEQ ID NO: 205 - protein, 88 aa, Homo sapiens
DIQLTQSPSTLSASVGDRVTITCRASQSISSWLAWYQQKPGKAPKLLIYDASSLESGVPSRFSGSGSGTEFTLTISSLQPDDFATYYC

SEQ ID NO: 206 - protein, 88 aa, Homo sapiens
DIQLTQSPSTLSASVGDRVTITCRASQGISSWLAWYQQKPGKAPKLLIYDASSLESGVPSRFSGSGSGTEFTLTISSLQPDDFATYYC

SEQ ID NO: 207 - protein, 88 aa, Homo sapiens
DIQLTQSPSTLSASVGDRVTITCRASQAISSWLAWYQQKPGKAPKLLIYDASSLESGVPSRFSGSGSGTEFTLTISSLQPDDFATYYC

SEQ ID NO: 208 - protein, 88 aa, Homo sapiens
DIQLTQSPSTLSASVGDRVTITCRASQSIGSWLAWYQQKPGKAPKLLIYDASSLESGVPSRFSGSGSGTEFTLTISSLQPDDFATYYC

SEQ ID NO: 209 - protein, 88 aa, Homo sapiens
DIQMTQSPSTLSASVGDRVTITCRASQSISSWLAWYQQKPGKAPKLLISDASSLESGVPSRFSGSGSGTEFTLTISSLQPDDFATYYC

SEQ ID NO: 210 - protein, 88 aa, Homo sapiens
DIQMTQSPSTLSASVGDRVTITCRASQSINSWLAWYQQKPGKAPKLLISDASSLESGVPSRFSGSGSGTEFTLTISSLQPDDFATYYC

SEQ ID NO: 211 - protein, 88 aa, Homo sapiens
DIQLTQSPSTLSASVGDRVTITCRASQSIGSWLAWYQQKPGKAPKLLIYKASSLESGVPSRFSGSGSGTEFTLTISSLQPDDFATYYC

SEQ ID NO: 212 - protein, 88 aa, Homo sapiens
DIQMTQSPSTLSASVGDRVTITCRASQSISSWLAWYQQKPGKAPKLLISKASSLESGVPSRFSGSGSGTEFTLTISSLQPDDFATYYC

SEQ ID NO: 213 - protein, 88 aa, Homo sapiens
DIQMTQSPSSVSASVGDRVTITCRASQGISSWLAWYQQKPGKAPKLLIYAASSLQSGVPSRFSGSGSGTDFTLTISSLQPEDFATYYC

SEQ ID NO: 214 - protein, 88 aa, Homo sapiens
DIQMTQSPSSVSASVGDRVTITCRASQGIGSWLAWYQQKPGKAPKLLIYAASSLQSGVPSRFSGSGSGTDFTLTISSLQPEDFATYYC

SEQ ID NO: 215 - protein, 88 aa, Homo sapiens
DIQMTQSPSSVSASVGDRVTITCRASQGIDSWLAWYQQKPGKAPKLLIYAASSLQSGVPSRFSGSGSGTDFTLTISSLQPEDFATYYC

SEQ ID NO: 216 - protein, 88 aa, Homo sapiens
DIQMTQSPSSVSASVGDRVTITCRASQGISRWLAWYQQKPGKAPKLLIYAASSLQSGVPSRFSGSGSGTDFTLTISSLQPEDFATYYC

SEQ ID NO: 217 - protein, 88 aa, Homo sapiens
DIQMTQSPSSVSASVGDRVTITCRASQGISSWLAWYQQKPGKAPKLLIYGASSLQSGVPSRFSGSGSGTDFTLTISSLQPEDFATYYC

SEQ ID NO: 218 - protein, 88 aa, Homo sapiens
DIQMTQSPSSVSASVGDRVTITCRASQGISSWLAWYQQKPGKAPKLLIYSASSLQSGVPSRFSGSGSGTDFTLTISSLQPEDFATYYC

SEQ ID NO: 219 - protein, 88 aa, Homo sapiens
DIQMTQSPSSVSASVGDRVTITCRASQGISSWLAWYQQKPGKAPKLLIYAASNLQSGVPSRFSGSGSGTDFTLTISSLQPEDFATYYC

SEQ ID NO: 220 - protein, 88 aa, Homo sapiens
DIQLTQSPSSVSASVGDRVTITCRASQGISSWLAWYQQKPGKAPKLLIYAASSLQSGVPSRFSGSGSGTDFTLTISSLQPEDFATYYC

SEQ ID NO: 221 - protein, 88 aa, Homo sapiens
DIQLTQSPSSVSASVGDRVTITCRASQDISSWLAWYQQKPGKAPKLLIYAASSLQSGVPSRFSGSGSGTDFTLTISSLQPEDFATYYC

SEQ ID NO: 222 - protein, 88 aa, Homo sapiens
DIQLTQSPSSVSASVGDRVTITCRASQGISRWLAWYQQKPGKAPKLLIYAASSLQSGVPSRFSGSGSGTDFTLTISSLQPEDFATYYC

SEQ ID NO: 223 - protein, 88 aa, Homo sapiens
DIQLTQSPSSVSASVGDRVTITCRASQGISSWLAWYQQKPGKAPKLLIYGASSLQSGVPSRFSGSGSGTDFTLTISSLQPEDFATYYC

SEQ ID NO: 224 - protein, 88 aa, Homo sapiens
DIQLTQSPSSVSASVGDRVTITCRASQGISSWLAWYQQKPGKAPKLLIYSASSLQSGVPSRFSGSGSGTDFTLTISSLQPEDFATYYC

SEQ ID NO: 225 - protein, 88 aa, Homo sapiens
DIQLTQSPSSVSASVGDRVTITCRASQGISSWLAWYQQKPGKAPKLLIYAASNLQSGVPSRFSGSGSGTDFTLTISSLQPEDFATYYC

SEQ ID NO: 226 - protein, 88 aa, Homo sapiens
DIQMTQSPSSVSASVGDRVTITCRASQGISSWLAWYQQKPGKAPKLLISAASSLQSGVPSRFSGSGSGTDFTLTISSLQPEDFATYYC

SEQ ID NO: 227 - protein, 88 aa, Homo sapiens
DIQMTQSPSSVSASVGDRVTITCRASQDISSWLAWYQQKPGKAPKLLISAASSLQSGVPSRFSGSGSGTDFTLTISSLQPEDFATYYC

SEQ ID NO: 228 - protein, 88 aa, Homo sapiens
DIQMTQSPSSVSASVGDRVTITCRASQGIDSWLAWYQQKPGKAPKLLISAASSLQSGVPSRFSGSGSGTDFTLTISSLQPEDFATYYC

SEQ ID NO: 229 - protein, 88 aa, Homo sapiens
DIQMTQSPSSVSASVGDRVTITCRASQGISRWLAWYQQKPGKAPKLLISAASSLQSGVPSRFSGSGSGTDFTLTISSLQPEDFATYYC

SEQ ID NO: 230 - protein, 88 aa, Homo sapiens
DIQMTQSPSSLSASVGDRVTITCQASQDISNYLNWYQQKPGKAPKLLIYDASNLETGVPSRFSGSGSGTDFTFTISSLQPEDIATYYC

SEQ ID NO: 231 - protein, 88 aa, Homo sapiens
DIQMTQSPSSLSASVGDRVTITCQASQDITNYLNWYQQKPGKAPKLLIYDASNLETGVPSRFSGSGSGTDFTFTISSLQPEDIATYYC

SEQ ID NO: 232 - protein, 88 aa, Homo sapiens
DIQMTQSPSSLSASVGDRVTITCQASQDIANYLNWYQQKPGKAPKLLIYDASNLETGVPSRFSGSGSGTDFTFTISSLQPEDIATYYC

SEQ ID NO: 233 - protein, 88 aa, Homo sapiens
DIQMTQSPSSLSASVGDRVTITCQASQDISNYLNWYQQKPGKAPKLLIYDASNLATGVPSRFSGSGSGTDFTFTISSLQPEDIATYYC

SEQ ID NO: 234 - protein, 88 aa, Homo sapiens
DIQLTQSPSSLSASVGDRVTITCQASQDISNYLNWYQQKPGKAPKLLIYDASNLETGVPSRFSGSGSGTDFTFTISSLQPEDIATYYC

SEQ ID NO: 235 - protein, 88 aa, Homo sapiens
DIQLTQSPSSLSASVGDRVTITCQASQDISNSLNWYQQKPGKAPKLLIYDASNLETGVPSRFSGSGSGTDFTFTISSLQPEDIATYYC

SEQ ID NO: 236 - protein, 88 aa, Homo sapiens
DIQLTQSPSSLSASVGDRVTITCQASQDISNFLNWYQQKPGKAPKLLIYDASNLETGVPSRFSGSGSGTDFTFTISSLQPEDIATYYC

SEQ ID NO: 237 - protein, 88 aa, Homo sapiens
DIQLTQSPSSLSASVGDRVTITCQASQDISNYLNWYQQKPGKAPKLLIYDASNLQTGVPSRFSGSGSGTDFTFTISSLQPEDIATYYC

SEQ ID NO: 238 - protein, 88 aa, Homo sapiens
DIQMTQSPSSLSASVGDRVTITCQASQDISNYLNWYQQKPGKAPKLLIYDASNLETGVPSRFSGSRSGTDFTFTISSLQPEDIATYYC

SEQ ID NO: 239 - protein, 88 aa, Homo sapiens
DIQMTQSPSSLSASVGDRVTITCQASQDITNYLNWYQQKPGKAPKLLIYDASNLETGVPSRFSGSRSGTDFTFTISSLQPEDIATYYC

SEQ ID NO: 240 - protein, 88 aa, Homo sapiens
DIQMTQSPSSLSASVGDRVTITCQASQDIANYLNWYQQKPGKAPKLLIYDASNLETGVPSRFSGSRSGTDFTFTISSLQPEDIATYYC

SEQ ID NO: 241 - protein, 88 aa, Homo sapiens
DIQMTQSPSSLSASVGDRVTITCQASQDISNSLNWYQQKPGKAPKLLIYDASNLETGVPSRFSGSRSGTDFTFTISSLQPEDIATYYC

SEQ ID NO: 242 - protein, 88 aa, Homo sapiens
DIQMTQSPSSLSASVGDRVTITCQASQDISNFLNWYQQKPGKAPKLLIYDASNLETGVPSRFSGSRSGTDFTFTISSLQPEDIATYYC

SEQ ID NO: 243 - protein, 93 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYC

SEQ ID NO: 244 - protein, 93 aa, Homo sapiens
DIVMTQSPLSLPVTPGEPASISCRSSQSLLYSNGYNYLDWYLQKPGQSPQLLIYLGSNRASGVPDRFSGSGSGTDFTLKISRVEAEDVGVYYC

SEQ ID NO: 245 - protein, 93 aa, Homo sapiens
DIVMTQSPLSLPVTPGEPASISCRSSQSLLHRNGYNYLDWYLQKPGQSPQLLIYLGSNRASGVPDRFSGSGSGTDFTLKISRVEAEDVGVYYC

SEQ ID NO: 246 - protein, 93 aa, Homo sapiens
DIVMTQSPLSLPVTPGEPASISCRSSQSLLHTNGYNYLDWYLQKPGQSPQLLIYLGSNRASGVPDRFSGSGSGTDFTLKISRVEAEDVGVYYC

SEQ ID NO: 247 - protein, 93 aa, Homo sapiens
DIVMTQSPLSLPVTPGEPASISCRSSQSLLHSNGNNYLDWYLQKPGQSPQLLIYLGSNRASGVPDRFSGSGSGTDFTLKISRVEAEDVGVYYC

SEQ ID NO: 248 - protein, 93 aa, Homo sapiens
DIVMTQSPLSLPVTPGEPASISCRSSQSLLHSNGYNYLDWYLQKPGQSPQLLIYLASNRASGVPDRFSGSGSGTDFTLKISRVEAEDVGVYYC

SEQ ID NO: 249 - protein, 93 aa, Homo sapiens
DIVMTQSPLSLPVTPGEPASISCRSSQSLLHSNGYNYLDWYLQKPGQSPQLLIYLGSHRASGVPDRFSGSGSGTDFTLKISRVEAEDVGVYYC

SEQ ID NO: 250 - protein, 93 aa, Homo sapiens
DIVMTQSPLSLPVTPGEPASISCRSSQSLLHSNGYNYLDWYLQKPGQSPQVLIYLGSNRASGVPDRFSGSGSGTDFTLKISRVEAEDVGVYYC

SEQ ID NO: 251 - protein, 93 aa, Homo sapiens
DIVMTQSPLSLPVTPGEPASISCRSSQSLLYSNGYNYLDWYLQKPGQSPQVLIYLGSNRASGVPDRFSGSGSGTDFTLKISRVEAEDVGVYYC

SEQ ID NO: 252 - protein, 93 aa, Homo sapiens
DIVMTQSPLSLPVTPGEPASISCRSSQSLLHSNGYNYLDWYLQKPGQSPQVLIYLASNRASGVPDRFSGSGSGTDFTLKISRVEAEDVGVYYC

SEQ ID NO: 253 - protein, 93 aa, Homo sapiens
DIVMTQSPLSLPVTPGEPASISCRSSQSLLHSNGYNYLDWYLQKPGQSPQVLIYLGSSRASGVPDRFSGSGSGTDFTLKISRVEAEDVGVYYC

SEQ ID NO: 254 - protein, 93 aa, Homo sapiens
DIVMTQSPLSLPVTPGEPASISCRSSQSLLHSNGYNYLDWYLQKPGQSPQLLIFLGSNRASGVPDRFSGSGSGTDFTLKISRVEAEDVGVYYC

SEQ ID NO: 255 - protein, 93 aa, Homo sapiens
DIVMTQSPLSLPVTPGEPASISCRSSQSLLHSNGNNYLDWYLQKPGQSPQLLIFLGSNRASGVPDRFSGSGSGTDFTLKISRVEAEDVGVYYC

SEQ ID NO: 256 - protein, 88 aa, Homo sapiens
EIVLTQSPATLSLSPGERATLSCRASQSVSSYLAWYQQKPGQAPRLLIYDASNRATGIPARFSGSGSGTDFTLTISSLEPEDFAVYYC

SEQ ID NO: 257 - protein, 88 aa, Homo sapiens
EIVLTQSPATLSLSPGERATLSCRASQSVSRYLAWYQQKPGQAPRLLIYDASNRATGIPARFSGSGSGTDFTLTISSLEPEDFAVYYC

SEQ ID NO: 258 - protein, 88 aa, Homo sapiens
EIVLTQSPATLSLSPGERATLSCRASQSVSNYLAWYQQKPGQAPRLLIYDASNRATGIPARFSGSGSGTDFTLTISSLEPEDFAVYYC

SEQ ID NO: 259 - protein, 88 aa, Homo sapiens
EIVLTQSPATLSLSPGERATLSCRASQSVSSYLAWYQQKPGQAPRLLIYDSSNRATGIPARFSGSGSGTDFTLTISSLEPEDFAVYYC

SEQ ID NO: 260 - protein, 88 aa, Homo sapiens
EIVLTQSPATLSLSPGERATLSCRASQSVSSYLAWYQQKPGQAPRLLIYDTSNRATGIPARFSGSGSGTDFTLTISSLEPEDFAVYYC

SEQ ID NO: 261 - protein, 88 aa, Homo sapiens
EIVLTQSPATLSLSPGERATLSCRASQSVSSYLAWYQQKPGQAPRLLIYDASKRATGIPARFSGSGSGTDFTLTISSLEPEDFAVYYC

SEQ ID NO: 262 - protein, 88 aa, Homo sapiens
EIVMTQSPATLSLSPGERATLSCRASQSVSSYLAWYQQKPGQAPRLLIYDASNRATGIPARFSGSGSGTDFTLTISSLEPEDFAVYYC

SEQ ID NO: 263 - protein, 88 aa, Homo sapiens
EIVMTQSPATLSLSPGERATLSCRASQSVSNYLAWYQQKPGQAPRLLIYDASNRATGIPARFSGSGSGTDFTLTISSLEPEDFAVYYC

SEQ ID NO: 264 - protein, 88 aa, Homo sapiens
EIVMTQSPATLSLSPGERATLSCRASQSVSSYLAWYQQKPGQAPRLLIYDSSNRATGIPARFSGSGSGTDFTLTISSLEPEDFAVYYC

SEQ ID NO: 265 - protein, 88 aa, Homo sapiens
EIVMTQSPATLSLSPGERATLSCRASQSVSSYLAWYQQKPGQAPRLLIYDTSNRATGIPARFSGSGSGTDFTLTISSLEPEDFAVYYC

SEQ ID NO: 266 - protein, 88 aa, Homo sapiens
EIVMTQSPATLSLSPGERATLSCRASQSVSSYLAWYQQKPGQAPRLLIYDASKRATGIPARFSGSGSGTDFTLTISSLEPEDFAVYYC

SEQ ID NO: 267 - protein, 88 aa, Homo sapiens
EIVLTQSPATLSLSPGERATLSCRASQSVSSYLAWFQQKPGQAPRLLIYDASNRATGIPARFSGSGSGTDFTLTISSLEPEDFAVYYC

SEQ ID NO: 268 - protein, 88 aa, Homo sapiens
EIVLTQSPATLSLSPGERATLSCRASQSISSYLAWFQQKPGQAPRLLIYDASNRATGIPARFSGSGSGTDFTLTISSLEPEDFAVYYC

SEQ ID NO: 269 - protein, 88 aa, Homo sapiens
EIVLTQSPATLSLSPGERATLSCRASQSVSSYLAWFQQKPGQAPRLLIYDSSNRATGIPARFSGSGSGTDFTLTISSLEPEDFAVYYC

SEQ ID NO: 270 - protein, 88 aa, Homo sapiens
EIVLTQSPATLSLSPGERATLSCRASQSVSSYLAWFQQKPGQAPRLLIYDTSNRATGIPARFSGSGSGTDFTLTISSLEPEDFAVYYC

SEQ ID NO: 271 - protein, 88 aa, Homo sapiens
EIVMTQSPATLSVSPGERATLSCRASQSVSSNLAWYQQKPGQAPRLLIYGASTRATGIPARFSGSGSGTEFTLTISSLQSEDFAVYYC

SEQ ID NO: 272 - protein, 88 aa, Homo sapiens
EIVMTQSPATLSVSPGERATLSCRASQSVGSNLAWYQQKPGQAPRLLIYGASTRATGIPARFSGSGSGTEFTLTISSLQSEDFAVYYC

SEQ ID NO: 273 - protein, 88 aa, Homo sapiens
EIVMTQSPATLSVSPGERATLSCRASQSVSSSLAWYQQKPGQAPRLLIYGASTRATGIPARFSGSGSGTEFTLTISSLQSEDFAVYYC

SEQ ID NO: 274 - protein, 88 aa, Homo sapiens
EIVMTQSPATLSVSPGERATLSCRASQSVSSNLAWYQQKPGQAPRLLIYDASTRATGIPARFSGSGSGTEFTLTISSLQSEDFAVYYC

SEQ ID NO: 275 - protein, 88 aa, Homo sapiens
EIVMTQSPATLSVSPGERATLSCRASQSVSSNLAWYQQKPGQAPRLLIYSASTRATGIPARFSGSGSGTEFTLTISSLQSEDFAVYYC

SEQ ID NO: 276 - protein, 88 aa, Homo sapiens
EIVLTQSPATLSVSPGERATLSCRASQSVSSNLAWYQQKPGQAPRLLIYGASTRATGIPARFSGSGSGTEFTLTISSLQSEDFAVYYC

SEQ ID NO: 277 - protein, 88 aa, Homo sapiens
EIVLTQSPATLSVSPGERATLSCRASQSVGSNLAWYQQKPGQAPRLLIYGASTRATGIPARFSGSGSGTEFTLTISSLQSEDFAVYYC

SEQ ID NO: 278 - protein, 88 aa, Homo sapiens
EIVLTQSPATLSVSPGERATLSCRASQSVSTNLAWYQQKPGQAPRLLIYGASTRATGIPARFSGSGSGTEFTLTISSLQSEDFAVYYC

SEQ ID NO: 279 - protein, 88 aa, Homo sapiens
EIVLTQSPATLSVSPGERATLSCRASQSVSSDLAWYQQKPGQAPRLLIYGASTRATGIPARFSGSGSGTEFTLTISSLQSEDFAVYYC

SEQ ID NO: 280 - protein, 88 aa, Homo sapiens
EIVMTQSPATLSVSPGERATLSCRASQSVSSNLAWYQQKPGQAPRLLIFGASTRATGIPARFSGSGSGTEFTLTISSLQSEDFAVYYC

SEQ ID NO: 281 - protein, 88 aa, Homo sapiens
EIVMTQSPATLSVSPGERATLSCRASQSVGSNLAWYQQKPGQAPRLLIFGASTRATGIPARFSGSGSGTEFTLTISSLQSEDFAVYYC

SEQ ID NO: 282 - protein, 88 aa, Homo sapiens
EIVMTQSPATLSVSPGERATLSCRASQSVSSDLAWYQQKPGQAPRLLIFGASTRATGIPARFSGSGSGTEFTLTISSLQSEDFAVYYC

SEQ ID NO: 283 - protein, 88 aa, Homo sapiens
EIVMTQSPATLSVSPGERATLSCRASQSVSSSLAWYQQKPGQAPRLLIFGASTRATGIPARFSGSGSGTEFTLTISSLQSEDFAVYYC

SEQ ID NO: 284 - protein, 89 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYC

SEQ ID NO: 285 - protein, 89 aa, Homo sapiens
EIVLTQSPGTLSLSPGERATLSCRASQSVRSSYLAWYQQKPGQAPRLLIYGASSRATGIPDRFSGSGSGTDFTLTISRLEPEDFAVYYC

SEQ ID NO: 286 - protein, 89 aa, Homo sapiens
EIVLTQSPGTLSLSPGERATLSCRASQSVSSDYLAWYQQKPGQAPRLLIYGASSRATGIPDRFSGSGSGTDFTLTISRLEPEDFAVYYC

SEQ ID NO: 287 - protein, 89 aa, Homo sapiens
EIVLTQSPGTLSLSPGERATLSCRASQSVSSSYLAWYQQKPGQAPRLLIYGASNRATGIPDRFSGSGSGTDFTLTISRLEPEDFAVYYC

SEQ ID NO: 288 - protein, 89 aa, Homo sapiens
EIVLTQSPGTLSLSPGERATLSCRASQSVSSSYLAWYQQKPGQAPRLLIYGASRRATGIPDRFSGSGSGTDFTLTISRLEPEDFAVYYC

SEQ ID NO: 289 - protein, 89 aa, Homo sapiens
EIVMTQSPGTLSLSPGERATLSCRASQSVSSSYLAWYQQKPGQAPRLLIYGASSRATGIPDRFSGSGSGTDFTLTISRLEPEDFAVYYC

SEQ ID NO: 290 - protein, 89 aa, Homo sapiens
EIVMTQSPGTLSLSPGERATLSCRASQSVSSSYLAWYQQKPGQAPRLLIYGASNRATGIPDRFSGSGSGTDFTLTISRLEPEDFAVYYC

SEQ ID NO: 291 - protein, 89 aa, Homo sapiens
EIVLTQSPGTLSLSPGERATLSCRASQSVSSSYLAWYQQKPGQAPRLLISGASSRATGIPDRFSGSGSGTDFTLTISRLEPEDFAVYYC

SEQ ID NO: 292 - protein, 89 aa, Homo sapiens
EIVLTQSPGTLSLSPGERATLSCRASQSVSSNYLAWYQQKPGQAPRLLISGASSRATGIPDRFSGSGSGTDFTLTISRLEPEDFAVYYC

SEQ ID NO: 293 - protein, 94 aa, Homo sapiens
DIVMTQSPDSLAVSLGERATINCKSSQSVLYSSNNKNYLAWYQQKPGQPPKLLIYWASTRESGVPDRFSGSGSGTDFTLTISSLQAEDVAVYYC

SEQ ID NO: 294 - protein, 94 aa, Homo sapiens
DIVMTQSPDSLAVSLGERATINCKSSQSLLYSSNNKNYLAWYQQKPGQPPKLLIYWASTRESGVPDRFSGSGSGTDFTLTISSLQAEDVAVYYC

SEQ ID NO: 295 - protein, 94 aa, Homo sapiens
DIVMTQSPDSLAVSLGERATINCKSSQSILYSSNNKNYLAWYQQKPGQPPKLLIYWASTRESGVPDRFSGSGSGTDFTLTISSLQAEDVAVYYC

SEQ ID NO: 296 - protein, 94 aa, Homo sapiens
DIVMTQSPDSLAVSLGERATINCKSSQSVLHSSNNKNYLAWYQQKPGQPPKLLIYWASTRESGVPDRFSGSGSGTDFTLTISSLQAEDVAVYYC

SEQ ID NO: 297 - protein, 94 aa, Homo sapiens
DIVMTQSPDSLAVSLGERATINCKSSQSVLFSSNNKNYLAWYQQKPGQPPKLLIYWASTRESGVPDRFSGSGSGTDFTLTISSLQAEDVAVYYC

SEQ ID NO: 298 - protein, 94 aa, Homo sapiens
DIVMTQSPDSLAVSLGERATINCKSSQSVLYTSNNKNYLAWYQQKPGQPPKLLIYWASTRESGVPDRFSGSGSGTDFTLTISSLQAEDVAVYYC

SEQ ID NO: 299 - protein, 94 aa, Homo sapiens
DIVMTQSPDSLAVSLGERATINCKSSQSVLYSSNNKNYLAWYQQKPGQPPKLLIYWASSRESGVPDRFSGSGSGTDFTLTISSLQAEDVAVYYC

SEQ ID NO: 300 - protein, 94 aa, Homo sapiens
DIVLTQSPDSLAVSLGERATINCKSSQSVLYSSNNKNYLAWYQQKPGQPPKLLIYWASTRESGVPDRFSGSGSGTDFTLTISSLQAEDVAVYYC

SEQ ID NO: 301 - protein, 94 aa, Homo sapiens
DIVLTQSPDSLAVSLGERATINCKSSQSVLHSSNNKNYLAWYQQKPGQPPKLLIYWASTRESGVPDRFSGSGSGTDFTLTISSLQAEDVAVYYC

SEQ ID NO: 302 - protein, 94 aa, Homo sapiens
DIVLTQSPDSLAVSLGERATINCKSSQSVLYSSNNKNYLAWYQQKPGQPPKLLIYWASSRESGVPDRFSGSGSGTDFTLTISSLQAEDVAVYYC

SEQ ID NO: 303 - protein, 94 aa, Homo sapiens
DIVMTQSPDSLAVSLGERATINCKSSQSVLYSSNNKNYLAWYQQKPGQPPKLLISWASTRESGVPDRFSGSGSGTDFTLTISSLQAEDVAVYYC

SEQ ID NO: 304 - protein, 94 aa, Homo sapiens
DIVMTQSPDSLAVSLGERATINCKSSQSVLHSSNNKNYLAWYQQKPGQPPKLLISWASTRESGVPDRFSGSGSGTDFTLTISSLQAEDVAVYYC

SEQ ID NO: 305 - DNA, 27 bp, Artificial Sequence
  Description of Artificial Sequence: Synthetic oligonucleotide
swmswmagctacagtactccttwcact

SEQ ID NO: 306 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactccttwcact

SEQ ID NO: 307 - DNA, 27 bp, Artificial Sequence
  Description of Artificial Sequence: Synthetic oligonucleotide
swmcaaagcbhcagtactccttwcact

SEQ ID NO: 308 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactccttwcact

SEQ ID NO: 309 - DNA, 27 bp, Artificial Sequence
  Description of Artificial Sequence: Synthetic oligonucleotide
swmcaaagctacagtbhcccttwcact

SEQ ID NO: 310 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactccttwcact

SEQ ID NO: 311 - DNA, 27 bp, Artificial Sequence
  Description of Artificial Sequence: Synthetic oligonucleotide
cagswmagcbhcagtactccttwcact

SEQ ID NO: 312 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactccttwcact

SEQ ID NO: 313 - DNA, 27 bp, Artificial Sequence
  Description of Artificial Sequence: Synthetic oligonucleotide
cagswmagctacagtbhcccttwcact

SEQ ID NO: 314 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactccttwcact

SEQ ID NO: 315 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactccttwcact

SEQ ID NO: 316 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhcccttwcact

SEQ ID NO: 317 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactccttwcact

SEQ ID NO: 318 - DNA, 27 bp, Artificial Sequence
  Description of Artificial Sequence: Synthetic oligonucleotide
cagcaaagcbhcagtbhcccttwcact

SEQ ID NO: 319 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhcccttwcact

SEQ ID NO: 320 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactccttwcact

SEQ ID NO: 321 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhcccttwcact

SEQ ID NO: 322 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhcccttwcact

SEQ ID NO: 323 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhcccttwcact

SEQ ID NO: 324 - DNA, 69 bp, Artificial Sequence
  Description of Artificial Sequence: Synthetic oligonucleotide
cctgatgattttgcaacttattactgcswmswmtacaatagttactwcacttttggcggagggaccaag

SEQ ID NO: 325 - DNA, 69 bp, Artificial Sequence
  Description of Artificial Sequence: Synthetic oligonucleotide
cctgatgattttgcaacttattactgccagcagbhcvrmagttactwcacttttggcggagggaccaag

SEQ ID NO: 326 - DNA, 69 bp, Artificial Sequence
  Description of Artificial Sequence: Synthetic oligonucleotide
cctgatgattttgcaacttattactgccagcagbhcaatmbctactwcacttttggcggagggaccaag

SEQ ID NO: 327 - DNA, 69 bp, Artificial Sequence
  Description of Artificial Sequence: Synthetic oligonucleotide
cctgatgattttgcaacttattactgccagcagbhcaatagtywctwcacttttggcggagggaccaag

SEQ ID NO: 328 - DNA, 69 bp, Artificial Sequence
  Description of Artificial Sequence: Synthetic oligonucleotide
cctgatgattttgcaacttattactgccagcagtacvrmmbctactwcacttttggcggagggaccaag

SEQ ID NO: 329 - DNA, 69 bp, Artificial Sequence
  Description of Artificial Sequence: Synthetic oligonucleotide
cctgatgattttgcaacttattactgccagcagtacvrmagtywctwcacttttggcggagggaccaag

SEQ ID NO: 330 - DNA, 69 bp, Artificial Sequence
  Description of Artificial Sequence: Synthetic oligonucleotide
cctgatgattttgcaacttattactgccagcagtacaatmbcywctwcacttttggcggagggaccaag

SEQ ID NO: 331 - DNA, 69 bp, Artificial Sequence
  Description of Artificial Sequence: Synthetic oligonucleotide
cctgatgattttgcaacttattactgcswmcagbhcaatagttactwcacttttggcggagggaccaag

SEQ ID NO: 332 - DNA, 69 bp, Artificial Sequence
  Description of Artificial Sequence: Synthetic oligonucleotide
cctgatgattttgcaacttattactgcswmcagtacvrmagttactwcacttttggcggagggaccaag

SEQ ID NO: 333 - DNA, 69 bp, Artificial Sequence
  Description of Artificial Sequence: Synthetic oligonucleotide
cctgatgattttgcaacttattactgcswmcagtacaatmbctactwcacttttggcggagggaccaag

SEQ ID NO: 334 - DNA, 69 bp, Artificial Sequence
  Description of Artificial Sequence: Synthetic oligonucleotide
cctgatgattttgcaacttattactgcswmcagtacaatagtywctwcacttttggcggagggaccaag

SEQ ID NO: 335 - DNA, 69 bp, Artificial Sequence
  Description of Artificial Sequence: Synthetic oligonucleotide
cctgatgattttgcaacttattactgccagswmbhcaatagttactwcacttttggcggagggaccaag

SEQ ID NO: 336 - DNA, 69 bp, Artificial Sequence
  Description of Artificial Sequence: Synthetic oligonucleotide
cctgatgattttgcaacttattactgccagswmtacvrmagttactwcacttttggcggagggaccaag

SEQ ID NO: 337 - DNA, 69 bp, Artificial Sequence
  Description of Artificial Sequence: Synthetic oligonucleotide
cctgatgattttgcaacttattactgccagswmtacaatmbctactwcacttttggcggagggaccaag

SEQ ID NO: 338 - DNA, 69 bp, Artificial Sequence
  Description of Artificial Sequence: Synthetic oligonucleotide
cctgatgattttgcaacttattactgccagswmtacaatagtywctwcacttttggcggagggaccaag

SEQ ID NO: 339 - DNA, 69 bp, Artificial Sequence
  Description of Artificial Sequence: Synthetic oligonucleotide
cctgatgattttgcaacttattactgcswmswmtacaatagttacmtcacttttggcggagggaccaag

SEQ ID NO: 340 - DNA, 69 bp, Artificial Sequence
  Description of Artificial Sequence: Synthetic oligonucleotide
cctgatgattttgcaacttattactgccagcagbhcvrmagttacmtcacttttggcggagggaccaag

SEQ ID NO: 341 - DNA, 69 bp, Artificial Sequence
  Description of Artificial Sequence: Synthetic oligonucleotide
cctgatgattttgcaacttattactgccagcagbhcaatmbctacmtcacttttggcggagggaccaag

SEQ ID NO: 342 - DNA, 69 bp, Artificial Sequence
  Description of Artificial Sequence: Synthetic oligonucleotide
cctgatgattttgcaacttattactgccagcagbhcaatagtywcmtcacttttggcggagggaccaag

SEQ ID NO: 343 - DNA, 69 bp, Artificial Sequence
  Description of Artificial Sequence: Synthetic oligonucleotide
cctgatgattttgcaacttattactgccagcagtacvrmmbctacmtcacttttggcggagggaccaag

SEQ ID NO: 344 - DNA, 69 bp, Artificial Sequence
  Description of Artificial Sequence: Synthetic oligonucleotide
cctgatgattttgcaacttattactgccagcagtacvrmagtywcmtcacttttggcggagggaccaag

SEQ ID NO: 345 - DNA, 69 bp, Artificial Sequence
  Description of Artificial Sequence: Synthetic oligonucleotide
cctgatgattttgcaacttattactgccagcagtacaatmbcywcmtcacttttggcggagggaccaag

SEQ ID NO: 346 - DNA, 69 bp, Artificial Sequence
  Description of Artificial Sequence: Synthetic oligonucleotide
cctgatgattttgcaacttattactgcswmcagbhcaatagttacmtcacttttggcggagggaccaag

SEQ ID NO: 347 - DNA, 69 bp, Artificial Sequence
  Description of Artificial Sequence: Synthetic oligonucleotide
cctgatgattttgcaacttattactgcswmcagtacvrmagttacmtcacttttggcggagggaccaag

SEQ ID NO: 348 - DNA, 69 bp, Artificial Sequence
  Description of Artificial Sequence: Synthetic oligonucleotide
cctgatgattttgcaacttattactgcswmcagtacaatmbctacmtcacttttggcggagggaccaag

SEQ ID NO: 349 - DNA, 69 bp, Artificial Sequence
  Description of Artificial Sequence: Synthetic oligonucleotide
cctgatgattttgcaacttattactgcswmcagtacaatagtywcmtcacttttggcggagggaccaag

SEQ ID NO: 350 - DNA, 69 bp, Artificial Sequence
  Description of Artificial Sequence: Synthetic oligonucleotide
cctgatgattttgcaacttattactgccagswmbhcaatagttacmtcacttttggcggagggaccaag

SEQ ID NO: 351 - DNA, 69 bp, Artificial Sequence
  Description of Artificial Sequence: Synthetic oligonucleotide
cctgatgattttgcaacttattactgccagswmtacvrmagttacmtcacttttggcggagggaccaag

SEQ ID NO: 352 - DNA, 69 bp, Artificial Sequence
  Description of Artificial Sequence: Synthetic oligonucleotide
cctgatgattttgcaacttattactgccagswmtacaatmbctacmtcacttttggcggagggaccaag

SEQ ID NO: 353 - DNA, 69 bp, Artificial Sequence
  Description of Artificial Sequence: Synthetic oligonucleotide
cctgatgattttgcaacttattactgccagswmtacaatagtywcmtcacttttggcggagggaccaag

SEQ ID NO: 354 - DNA, 69 bp, Artificial Sequence
  Description of Artificial Sequence: Synthetic oligonucleotide
cctgatgattttgcaacttattactgcswmswmtacaatagttacwggacttttggcggagggaccaag

SEQ ID NO: 355 - DNA, 69 bp, Artificial Sequence
  Description of Artificial Sequence: Synthetic oligonucleotide
cctgatgattttgcaacttattactgccagcagbhcvrmagttacwggacttttggcggagggaccaag

SEQ ID NO: 356 - DNA, 69 bp, Artificial Sequence
  Description of Artificial Sequence: Synthetic oligonucleotide
cctgatgattttgcaacttattactgccagcagbhcaatmbctacwggacttttggcggagggaccaag

SEQ ID NO: 357 - DNA, 69 bp, Artificial Sequence
  Description of Artificial Sequence: Synthetic oligonucleotide
cctgatgattttgcaacttattactgccagcagbhcaatagtywcwggacttttggcggagggaccaag

SEQ ID NO: 358 - DNA, 69 bp, Artificial Sequence
  Description of Artificial Sequence: Synthetic oligonucleotide
cctgatgattttgcaacttattactgccagcagtacvrmmbctacwggacttttggcggagggaccaag

SEQ ID NO: 359 - DNA, 69 bp, Artificial Sequence
  Description of Artificial Sequence: Synthetic oligonucleotide
cctgatgattttgcaacttattactgccagcagtacvrmagtywcwggacttttggcggagggaccaag

SEQ ID NO: 360 - DNA, 69 bp, Artificial Sequence
  Description of Artificial Sequence: Synthetic oligonucleotide
cctgatgattttgcaacttattactgccagcagtacaatmbcywcwggacttttggcggagggaccaag

SEQ ID NO: 361 - DNA, 69 bp, Artificial Sequence
  Description of Artificial Sequence: Synthetic oligonucleotide
cctgatgattttgcaacttattactgcswmcagbhcaatagttacwggacttttggcggagggaccaag

SEQ ID NO: 362 - DNA, 69 bp, Artificial Sequence
  Description of Artificial Sequence: Synthetic oligonucleotide
cctgatgattttgcaacttattactgcswmcagtacvrmagttacwggacttttggcggagggaccaag

SEQ ID NO: 363 - DNA, 69 bp, Artificial Sequence
  Description of Artificial Sequence: Synthetic oligonucleotide
cctgatgattttgcaacttattactgcswmcagtacaatmbctacwggacttttggcggagggaccaag

SEQ ID NO: 364 - DNA, 69 bp, Artificial Sequence
  Description of Artificial Sequence: Synthetic oligonucleotide
cctgatgattttgcaacttattactgcswmcagtacaatagtywcwggacttttggcggagggaccaag

SEQ ID NO: 365 - DNA, 69 bp, Artificial Sequence
  Description of Artificial Sequence: Synthetic oligonucleotide
cctgatgattttgcaacttattactgccagswmbhcaatagttacwggacttttggcggagggaccaag

SEQ ID NO: 366 - DNA, 69 bp, Artificial Sequence
  Description of Artificial Sequence: Synthetic oligonucleotide
cctgatgattttgcaacttattactgccagswmtacvrmagttacwggacttttggcggagggaccaag

SEQ ID NO: 367 - DNA, 69 bp, Artificial Sequence
  Description of Artificial Sequence: Synthetic oligonucleotide
cctgatgattttgcaacttattactgccagswmtacaatmbctacwggacttttggcggagggaccaag

SEQ ID NO: 368 - DNA, 69 bp, Artificial Sequence
  Description of Artificial Sequence: Synthetic oligonucleotide
cctgatgattttgcaacttattactgccagswmtacaatagtywcwggacttttggcggagggaccaag

SEQ ID NO: 369 - DNA, 69 bp, Artificial Sequence
  Description of Artificial Sequence: Synthetic oligonucleotide
cctgatgattttgcaacttattactgcswmswmtacaatagttaccctacttttggcggagggaccaag

SEQ ID NO: 370 - DNA, 69 bp, Artificial Sequence
  Description of Artificial Sequence: Synthetic oligonucleotide
cctgatgattttgcaacttattactgccagcagbhcvrmagttaccctacttttggcggagggaccaag

SEQ ID NO: 371 - DNA, 69 bp, Artificial Sequence
  Description of Artificial Sequence: Synthetic oligonucleotide
cctgatgattttgcaacttattactgccagcagbhcaatmbctaccctacttttggcggagggaccaag

SEQ ID NO: 372 - DNA, 69 bp, Artificial Sequence
  Description of Artificial Sequence: Synthetic oligonucleotide
cctgatgattttgcaacttattactgccagcagbhcaatagtywccctacttttggcggagggaccaag

SEQ ID NO: 373 - DNA, 69 bp, Artificial Sequence
  Description of Artificial Sequence: Synthetic oligonucleotide
cctgatgattttgcaacttattactgccagcagtacvrmmbctaccctacttttggcggagggaccaag

SEQ ID NO: 374 - DNA, 69 bp, Artificial Sequence
  Description of Artificial Sequence: Synthetic oligonucleotide
cctgatgattttgcaacttattactgccagcagtacvrmagtywccctacttttggcggagggaccaag

SEQ ID NO: 375 - DNA, 69 bp, Artificial Sequence
  Description of Artificial Sequence: Synthetic oligonucleotide
cctgatgattttgcaacttattactgccagcagtacaatmbcywccctacttttggcggagggaccaag

SEQ ID NO: 376 - DNA, 69 bp, Artificial Sequence
  Description of Artificial Sequence: Synthetic oligonucleotide
cctgatgattttgcaacttattactgcswmcagbhcaatagttaccctacttttggcggagggaccaag

SEQ ID NO: 377 - DNA, 69 bp, Artificial Sequence
  Description of Artificial Sequence: Synthetic oligonucleotide
cctgatgattttgcaacttattactgcswmcagtacvrmagttaccctacttttggcggagggaccaag

SEQ ID NO: 378 - DNA, 69 bp, Artificial Sequence
  Description of Artificial Sequence: Synthetic oligonucleotide
cctgatgattttgcaacttattactgcswmcagtacaatmbctaccctacttttggcggagggaccaag

SEQ ID NO: 379 - DNA, 69 bp, Artificial Sequence
  Description of Artificial Sequence: Synthetic oligonucleotide
cctgatgattttgcaacttattactgcswmcagtacaatagtywccctacttttggcggagggaccaag

SEQ ID NO: 380 - DNA, 69 bp, Artificial Sequence
  Description of Artificial Sequence: Synthetic oligonucleotide
cctgatgattttgcaacttattactgccagswmbhcaatagttaccctacttttggcggagggaccaag

SEQ ID NO: 381 - DNA, 69 bp, Artificial Sequence
  Description of Artificial Sequence: Synthetic oligonucleotide
cctgatgattttgcaacttattactgccagswmtacvrmagttaccctacttttggcggagggaccaag

SEQ ID NO: 382 - DNA, 69 bp, Artificial Sequence
  Description of Artificial Sequence: Synthetic oligonucleotide
cctgatgattttgcaacttattactgccagswmtacaatmbctaccctacttttggcggagggaccaag

SEQ ID NO: 383 - DNA, 69 bp, Artificial Sequence
  Description of Artificial Sequence: Synthetic oligonucleotide
cctgatgattttgcaacttattactgccagswmtacaatagtywccctacttttggcggagggaccaag

SEQ ID NO: 384 - DNA, 69 bp, Artificial Sequence
  Description of Artificial Sequence: Synthetic oligonucleotide
cctgaagattttgcaacttattactgtswmswmgcaaatagtttctwcacttttggcggagggaccaag

SEQ ID NO: 385 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttctwcacttttggcggagggaccaag

SEQ ID NO: 386 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttctwcacttttggcggagggaccaag

SEQ ID NO: 387 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywctwcacttttggcggagggaccaag

SEQ ID NO: 388 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttctwcacttttggcggagggaccaag

SEQ ID NO: 389 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywctwcacttttggcggagggaccaag

SEQ ID NO: 390 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywctwcacttttggcggagggaccaag

SEQ ID NO: 391 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttctwcacttttggcggagggaccaag

SEQ ID NO: 392 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttctwcacttttggcggagggaccaag

SEQ ID NO: 393 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttctwcacttttggcggagggaccaag

SEQ ID NO: 394 - DNA, 69 bp, Artificial Sequence
  Description of Artificial Sequence: Synthetic oligonucleotide
cctgaagattttgcaacttattactgtswmcaggcaaatagtywctwcacttttggcggagggaccaag

SEQ ID NO: 395 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttctwcacttttggcggagggaccaag

SEQ ID NO: 396 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttctwcacttttggcggagggaccaag

SEQ ID NO: 397 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttctwcacttttggcggagggaccaag

SEQ ID NO: 398 - DNA, 69 bp, Artificial Sequence
  Description of Artificial Sequence: Synthetic oligonucleotide
cctgaagattttgcaacttattactgtcagswmgcaaatagtywctwcacttttggcggagggaccaag

SEQ ID NO: 399 - DNA, 69 bp, Artificial Sequence
  Description of Artificial Sequence: Synthetic oligonucleotide
cctgaagattttgcaacttattactgtswmswmgcaaatagtttcmtcacttttggcggagggaccaag

SEQ ID NO: 400 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttcmtcacttttggcggagggaccaag

SEQ ID NO: 401 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttcmtcacttttggcggagggaccaag

SEQ ID NO: 402 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywcmtcacttttggcggagggaccaag

SEQ ID NO: 403 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttcmtcacttttggcggagggaccaag

SEQ ID NO: 404 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywcmtcacttttggcggagggaccaag

SEQ ID NO: 405 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywcmtcacttttggcggagggaccaag

SEQ ID NO: 406 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttcmtcacttttggcggagggaccaag

SEQ ID NO: 407 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttcmtcacttttggcggagggaccaag

SEQ ID NO: 408 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttcmtcacttttggcggagggaccaag

SEQ ID NO: 409 - DNA, 69 bp, Artificial Sequence
  Description of Artificial Sequence: Synthetic oligonucleotide
cctgaagattttgcaacttattactgtswmcaggcaaatagtywcmtcacttttggcggagggaccaag

SEQ ID NO: 410 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttcmtcacttttggcggagggaccaag

SEQ ID NO: 411 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttcmtcacttttggcggagggaccaag

SEQ ID NO: 412 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttcmtcacttttggcggagggaccaag

SEQ ID NO: 413 - DNA, 69 bp, Artificial Sequence
  Description of Artificial Sequence: Synthetic oligonucleotide
cctgaagattttgcaacttattactgtcagswmgcaaatagtywcmtcacttttggcggagggaccaag

SEQ ID NO: 414 - DNA, 69 bp, Artificial Sequence
  Description of Artificial Sequence: Synthetic oligonucleotide
cctgaagattttgcaacttattactgtswmswmgcaaatagtttcwggacttttggcggagggaccaag

SEQ ID NO: 415 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttcwggacttttggcggagggaccaag

SEQ ID NO: 416 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttcwggacttttggcggagggaccaag

SEQ ID NO: 417 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywcwggacttttggcggagggaccaag

SEQ ID NO: 418 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttcwggacttttggcggagggaccaag

SEQ ID NO: 419 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywcwggacttttggcggagggaccaag

SEQ ID NO: 420 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywcwggacttttggcggagggaccaag

SEQ ID NO: 421 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttcwggacttttggcggagggaccaag

SEQ ID NO: 422 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttcwggacttttggcggagggaccaag

SEQ ID NO: 423 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttcwggacttttggcggagggaccaag

SEQ ID NO: 424 - DNA, 69 bp, Artificial Sequence
  Description of Artificial Sequence: Synthetic oligonucleotide
cctgaagattttgcaacttattactgtswmcaggcaaatagtywcwggacttttggcggagggaccaag

SEQ ID NO: 425 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttcwggacttttggcggagggaccaag

SEQ ID NO: 426 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttcwggacttttggcggagggaccaag

SEQ ID NO: 427 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttcwggacttttggcggagggaccaag

SEQ ID NO: 428 - DNA, 69 bp, Artificial Sequence
  Description of Artificial Sequence: Synthetic oligonucleotide
cctgaagattttgcaacttattactgtcagswmgcaaatagtywcwggacttttggcggagggaccaag

SEQ ID NO: 429 - DNA, 69 bp, Artificial Sequence
  Description of Artificial Sequence: Synthetic oligonucleotide
cctgaagattttgcaacttattactgtswmswmgcaaatagtttccctacttttggcggagggaccaag

SEQ ID NO: 430 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctacttttggcggagggaccaag

SEQ ID NO: 431 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctacttttggcggagggaccaag

SEQ ID NO: 432 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctacttttggcggagggaccaag

SEQ ID NO: 433 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctacttttggcggagggaccaag

SEQ ID NO: 434 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctacttttggcggagggaccaag

SEQ ID NO: 435 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctacttttggcggagggaccaag

SEQ ID NO: 436 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctacttttggcggagggaccaag

SEQ ID NO: 437 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctacttttggcggagggaccaag

SEQ ID NO: 438 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctacttttggcggagggaccaag

SEQ ID NO: 439 - DNA, 69 bp, Artificial Sequence
  Description of Artificial Sequence: Synthetic oligonucleotide
cctgaagattttgcaacttattactgtswmcaggcaaatagtywccctacttttggcggagggaccaag

SEQ ID NO: 440 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctacttttggcggagggaccaag

SEQ ID NO: 441 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctacttttggcggagggaccaag

SEQ ID NO: 442 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctacttttggcggagggaccaag

SEQ ID NO: 443 - DNA, 69 bp, Artificial Sequence
  Description of Artificial Sequence: Synthetic oligonucleotide
cctgaagattttgcaacttattactgtcagswmgcaaatagtywccctacttttggcggagggaccaag

SEQ ID NO: 444 - DNA, 69 bp, Artificial Sequence
  Description of Artificial Sequence: Synthetic oligonucleotide
cctgaagatattgcaacatattactgtswmswmtacgataatctctwcacttttggcggagggaccaag

SEQ ID NO: 445 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctctwcacttttggcggagggaccaag

SEQ ID NO: 446 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctctwcacttttggcggagggaccaag

SEQ ID NO: 447 - DNA, 69 bp, Artificial Sequence
  Description of Artificial Sequence: Synthetic oligonucleotide
cctgaagatattgcaacatattactgtcagcagbhcgataatywctwcacttttggcggagggaccaag

SEQ ID NO: 448 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctctwcacttttggcggagggaccaag

SEQ ID NO: 449 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywctwcacttttggcggagggaccaag

SEQ ID NO: 450 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywctwcacttttggcggagggaccaag

SEQ ID NO: 451 - DNA, 69 bp, Artificial Sequence
  Description of Artificial Sequence: Synthetic oligonucleotide
cctgaagatattgcaacatattactgtswmcagbhcgataatctctwcacttttggcggagggaccaag

SEQ ID NO: 452 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctctwcacttttggcggagggaccaag

SEQ ID NO: 453 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctctwcacttttggcggagggaccaag

SEQ ID NO: 454 - DNA, 69 bp, Artificial Sequence
  Description of Artificial Sequence: Synthetic oligonucleotide
cctgaagatattgcaacatattactgtswmcagtacgataatywctwcacttttggcggagggaccaag

SEQ ID NO: 455 - DNA, 69 bp, Artificial Sequence
  Description of Artificial Sequence: Synthetic oligonucleotide
cctgaagatattgcaacatattactgtcagswmbhcgataatctctwcacttttggcggagggaccaag

SEQ ID NO: 456 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctctwcacttttggcggagggaccaag

SEQ ID NO: 457 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctctwcacttttggcggagggaccaag

SEQ ID NO: 458 - DNA, 69 bp, Artificial Sequence
  Description of Artificial Sequence: Synthetic oligonucleotide
cctgaagatattgcaacatattactgtcagswmtacgataatywctwcacttttggcggagggaccaag

SEQ ID NO: 459 - DNA, 69 bp, Artificial Sequence
  Description of Artificial Sequence: Synthetic oligonucleotide
cctgaagatattgcaacatattactgtswmswmtacgataatctcmtcacttttggcggagggaccaag

SEQ ID NO: 460 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctcmtcacttttggcggagggaccaag

SEQ ID NO: 461 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctcmtcacttttggcggagggaccaag

SEQ ID NO: 462 - DNA, 69 bp, Artificial Sequence
  Description of Artificial Sequence: Synthetic oligonucleotide
cctgaagatattgcaacatattactgtcagcagbhcgataatywcmtcacttttggcggagggaccaag

SEQ ID NO: 463 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctcmtcacttttggcggagggaccaag

SEQ ID NO: 464 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywcmtcacttttggcggagggaccaag

SEQ ID NO: 465 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywcmtcacttttggcggagggaccaag

SEQ ID NO: 466 - DNA, 69 bp, Artificial Sequence
  Description of Artificial Sequence: Synthetic oligonucleotide
cctgaagatattgcaacatattactgtswmcagbhcgataatctcmtcacttttggcggagggaccaag

SEQ ID NO: 467 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctcmtcacttttggcggagggaccaag

SEQ ID NO: 468 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctcmtcacttttggcggagggaccaag

SEQ ID NO: 469 - DNA, 69 bp, Artificial Sequence
  Description of Artificial Sequence: Synthetic oligonucleotide
cctgaagatattgcaacatattactgtswmcagtacgataatywcmtcacttttggcggagggaccaag

SEQ ID NO: 470 - DNA, 69 bp, Artificial Sequence
  Description of Artificial Sequence: Synthetic oligonucleotide
cctgaagatattgcaacatattactgtcagswmbhcgataatctcmtcacttttggcggagggaccaag

SEQ ID NO: 471 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctcmtcacttttggcggagggaccaag

SEQ ID NO: 472 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctcmtcacttttggcggagggaccaag

SEQ ID NO: 473 - DNA, 69 bp, Artificial Sequence
  Description of Artificial Sequence: Synthetic oligonucleotide
cctgaagatattgcaacatattactgtcagswmtacgataatywcmtcacttttggcggagggaccaag

SEQ ID NO: 474 - DNA, 69 bp, Artificial Sequence
  Description of Artificial Sequence: Synthetic oligonucleotide
cctgaagatattgcaacatattactgtswmswmtacgataatctcwggacttttggcggagggaccaag

SEQ ID NO: 475 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctcwggacttttggcggagggaccaag

SEQ ID NO: 476 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctcwggacttttggcggagggaccaag

SEQ ID NO: 477 - DNA, 69 bp, Artificial Sequence
  Description of Artificial Sequence: Synthetic oligonucleotide
cctgaagatattgcaacatattactgtcagcagbhcgataatywcwggacttttggcggagggaccaag

SEQ ID NO: 478 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctcwggacttttggcggagggaccaag

SEQ ID NO: 479 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywcwggacttttggcggagggaccaag

SEQ ID NO: 480 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywcwggacttttggcggagggaccaag

SEQ ID NO: 481 - DNA, 69 bp, Artificial Sequence
  Description of Artificial Sequence: Synthetic oligonucleotide
cctgaagatattgcaacatattactgtswmcagbhcgataatctcwggacttttggcggagggaccaag

SEQ ID NO: 482 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctcwggacttttggcggagggaccaag

SEQ ID NO: 483 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctcwggacttttggcggagggaccaag

SEQ ID NO: 484 - DNA, 69 bp, Artificial Sequence
  Description of Artificial Sequence: Synthetic oligonucleotide
cctgaagatattgcaacatattactgtswmcagtacgataatywcwggacttttggcggagggaccaag

SEQ ID NO: 485 - DNA, 69 bp, Artificial Sequence
  Description of Artificial Sequence: Synthetic oligonucleotide
cctgaagatattgcaacatattactgtcagswmbhcgataatctcwggacttttggcggagggaccaag

SEQ ID NO: 486 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctcwggacttttggcggagggaccaag

SEQ ID NO: 487 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctcwggacttttggcggagggaccaag

SEQ ID NO: 488 - DNA, 69 bp, Artificial Sequence
  Description of Artificial Sequence: Synthetic oligonucleotide
cctgaagatattgcaacatattactgtcagswmtacgataatywcwggacttttggcggagggaccaag

SEQ ID NO: 489 - DNA, 69 bp, Artificial Sequence
  Description of Artificial Sequence: Synthetic oligonucleotide
cctgaagatattgcaacatattactgtswmswmtacgataatctccctacttttggcggagggaccaag

SEQ ID NO: 490 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctacttttggcggagggaccaag

SEQ ID NO: 491 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctacttttggcggagggaccaag

SEQ ID NO: 492 - DNA, 69 bp, Artificial Sequence
  Description of Artificial Sequence: Synthetic oligonucleotide
cctgaagatattgcaacatattactgtcagcagbhcgataatywccctacttttggcggagggaccaag

SEQ ID NO: 493 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctacttttggcggagggaccaag

SEQ ID NO: 494 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctacttttggcggagggaccaag

SEQ ID NO: 495 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctacttttggcggagggaccaag

SEQ ID NO: 496 - DNA, 69 bp, Artificial Sequence
  Description of Artificial Sequence: Synthetic oligonucleotide
cctgaagatattgcaacatattactgtswmcagbhcgataatctccctacttttggcggagggaccaag

SEQ ID NO: 497 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctacttttggcggagggaccaag

SEQ ID NO: 498 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctacttttggcggagggaccaag

SEQ ID NO: 499 - DNA, 69 bp, Artificial Sequence
  Description of Artificial Sequence: Synthetic oligonucleotide
cctgaagatattgcaacatattactgtswmcagtacgataatywccctacttttggcggagggaccaag

SEQ ID NO: 500 - DNA, 69 bp, Artificial Sequence
  Description of Artificial Sequence: Synthetic oligonucleotide
cctgaagatattgcaacatattactgtcagswmbhcgataatctccctacttttggcggagggaccaag

SEQ ID NO: 501 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctacttttggcggagggaccaag

SEQ ID NO: 502 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctacttttggcggagggaccaag

SEQ ID NO: 503 - DNA, 69 bp, Artificial Sequence
  Description of Artificial Sequence: Synthetic oligonucleotide
cctgaagatattgcaacatattactgtcagswmtacgataatywccctacttttggcggagggaccaag

SEQ ID NO: 504 - DNA, 69 bp, Artificial Sequence
  Description of Artificial Sequence: Synthetic oligonucleotide
cctgaagattttgcaacttactactgtswmswmagctacagtacttwcacttttggcggagggaccaag

SEQ ID NO: 505 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtacttwcacttttggcggagggaccaag

SEQ ID NO: 506 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcacttwcacttttggcggagggaccaag

SEQ ID NO: 507 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhctwcacttttggcggagggaccaag

SEQ ID NO: 508 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcacttwcacttttggcggagggaccaag

SEQ ID NO: 509 - DNA, 69 bp, Artificial Sequence
  Description of Artificial Sequence: Synthetic oligonucleotide
cctgaagattttgcaacttactactgtcagcaaagcbhcagtbhctwcacttttggcggagggaccaag

SEQ ID NO: 510 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhctwcacttttggcggagggaccaag

SEQ ID NO: 511 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtacttwcacttttggcggagggaccaag

SEQ ID NO: 512 - DNA, 69 bp, Artificial Sequence
  Description of Artificial Sequence: Synthetic oligonucleotide
cctgaagattttgcaacttactactgtswmcaaagcbhcagtacttwcacttttggcggagggaccaag

SEQ ID NO: 513 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcacttwcacttttggcggagggaccaag

SEQ ID NO: 514 - DNA, 69 bp, Artificial Sequence
  Description of Artificial Sequence: Synthetic oligonucleotide
cctgaagattttgcaacttactactgtswmcaaagctacagtbhctwcacttttggcggagggaccaag

SEQ ID NO: 515 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtacttwcacttttggcggagggaccaag

SEQ ID NO: 516 - DNA, 69 bp, Artificial Sequence
  Description of Artificial Sequence: Synthetic oligonucleotide
cctgaagattttgcaacttactactgtcagswmagcbhcagtacttwcacttttggcggagggaccaag

SEQ ID NO: 517 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcacttwcacttttggcggagggaccaag

SEQ ID NO: 518 - DNA, 69 bp, Artificial Sequence
  Description of Artificial Sequence: Synthetic oligonucleotide
cctgaagattttgcaacttactactgtcagswmagctacagtbhctwcacttttggcggagggaccaag

SEQ ID NO: 519 - DNA, 69 bp, Artificial Sequence
  Description of Artificial Sequence: Synthetic oligonucleotide
cctgaagattttgcaacttactactgtswmswmagctacagtactmtcacttttggcggagggaccaag

SEQ ID NO: 520 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactmtcacttttggcggagggaccaag

SEQ ID NO: 521 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactmtcacttttggcggagggaccaag

SEQ ID NO: 522 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhcmtcacttttggcggagggaccaag

SEQ ID NO: 523 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactmtcacttttggcggagggaccaag

SEQ ID NO: 524 - DNA, 69 bp, Artificial Sequence
  Description of Artificial Sequence: Synthetic oligonucleotide
cctgaagattttgcaacttactactgtcagcaaagcbhcagtbhcmtcacttttggcggagggaccaag

SEQ ID NO: 525 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhcmtcacttttggcggagggaccaag

SEQ ID NO: 526 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactmtcacttttggcggagggaccaag

SEQ ID NO: 527 - DNA, 69 bp, Artificial Sequence
  Description of Artificial Sequence: Synthetic oligonucleotide
cctgaagattttgcaacttactactgtswmcaaagcbhcagtactmtcacttttggcggagggaccaag

SEQ ID NO: 528 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactmtcacttttggcggagggaccaag

SEQ ID NO: 529 - DNA, 69 bp, Artificial Sequence
  Description of Artificial Sequence: Synthetic oligonucleotide
cctgaagattttgcaacttactactgtswmcaaagctacagtbhcmtcacttttggcggagggaccaag

SEQ ID NO: 530 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactmtcacttttggcggagggaccaag

SEQ ID NO: 531 - DNA, 69 bp, Artificial Sequence
  Description of Artificial Sequence: Synthetic oligonucleotide
cctgaagattttgcaacttactactgtcagswmagcbhcagtactmtcacttttggcggagggaccaag

SEQ ID NO: 532 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactmtcacttttggcggagggaccaag

SEQ ID NO: 533 - DNA, 69 bp, Artificial Sequence
  Description of Artificial Sequence: Synthetic oligonucleotide
cctgaagattttgcaacttactactgtcagswmagctacagtbhcmtcacttttggcggagggaccaag

SEQ ID NO: 534 - DNA, 69 bp, Artificial Sequence
  Description of Artificial Sequence: Synthetic oligonucleotide
cctgaagattttgcaacttactactgtswmswmagctacagtactwggacttttggcggagggaccaag

SEQ ID NO: 535 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactwggacttttggcggagggaccaag

SEQ ID NO: 536 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactwggacttttggcggagggaccaag

SEQ ID NO: 537 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhcwggacttttggcggagggaccaag

SEQ ID NO: 538 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactwggacttttggcggagggaccaag

SEQ ID NO: 539 - DNA, 69 bp, Artificial Sequence
  Description of Artificial Sequence: Synthetic oligonucleotide
cctgaagattttgcaacttactactgtcagcaaagcbhcagtbhcwggacttttggcggagggaccaag

SEQ ID NO: 540 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhcwggacttttggcggagggaccaag

SEQ ID NO: 541 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactwggacttttggcggagggaccaag

SEQ ID NO: 542 - DNA, 69 bp, Artificial Sequence
  Description of Artificial Sequence: Synthetic oligonucleotide
cctgaagattttgcaacttactactgtswmcaaagcbhcagtactwggacttttggcggagggaccaag

SEQ ID NO: 543 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactwggacttttggcggagggaccaag

SEQ ID NO: 544 - DNA, 69 bp, Artificial Sequence
  Description of Artificial Sequence: Synthetic oligonucleotide
cctgaagattttgcaacttactactgtswmcaaagctacagtbhcwggacttttggcggagggaccaag

SEQ ID NO: 545 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactwggacttttggcggagggaccaag

SEQ ID NO: 546 - DNA, 69 bp, Artificial Sequence
  Description of Artificial Sequence: Synthetic oligonucleotide
cctgaagattttgcaacttactactgtcagswmagcbhcagtactwggacttttggcggagggaccaag

SEQ ID NO: 547 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactwggacttttggcggagggaccaag

SEQ ID NO: 548 - DNA, 69 bp, Artificial Sequence
  Description of Artificial Sequence: Synthetic oligonucleotide
cctgaagattttgcaacttactactgtcagswmagctacagtbhcwggacttttggcggagggaccaag

SEQ ID NO: 549 - DNA, 69 bp, Artificial Sequence
  Description of Artificial Sequence: Synthetic oligonucleotide
cctgaagattttgcaacttactactgtswmswmagctacagtactcctacttttggcggagggaccaag

SEQ ID NO: 550 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctacttttggcggagggaccaag

SEQ ID NO: 551 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctacttttggcggagggaccaag

SEQ ID NO: 552 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctacttttggcggagggaccaag

SEQ ID NO: 553 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctacttttggcggagggaccaag

SEQ ID NO: 554 - DNA, 69 bp, Artificial Sequence
  Description of Artificial Sequence: Synthetic oligonucleotide
cctgaagattttgcaacttactactgtcagcaaagcbhcagtbhccctacttttggcggagggaccaag

SEQ ID NO: 555 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctacttttggcggagggaccaag

SEQ ID NO: 556 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctacttttggcggagggaccaag

SEQ ID NO: 557 - DNA, 69 bp, Artificial Sequence
  Description of Artificial Sequence: Synthetic oligonucleotide
cctgaagattttgcaacttactactgtswmcaaagcbhcagtactcctacttttggcggagggaccaag

SEQ ID NO: 558 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctacttttggcggagggaccaag

SEQ ID NO: 559 - DNA, 69 bp, Artificial Sequence
  Description of Artificial Sequence: Synthetic oligonucleotide
cctgaagattttgcaacttactactgtswmcaaagctacagtbhccctacttttggcggagggaccaag

SEQ ID NO: 560 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctacttttggcggagggaccaag

SEQ ID NO: 561 - DNA, 69 bp, Artificial Sequence
  Description of Artificial Sequence: Synthetic oligonucleotide
cctgaagattttgcaacttactactgtcagswmagcbhcagtactcctacttttggcggagggaccaag

SEQ ID NO: 562 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctacttttggcggagggaccaag

SEQ ID NO: 563 - DNA, 69 bp, Artificial Sequence
  Description of Artificial Sequence: Synthetic oligonucleotide
cctgaagattttgcaacttactactgtcagswmagctacagtbhccctacttttggcggagggaccaag

SEQ ID NO: 564 - DNA, 69 bp, Artificial Sequence
  Description of Artificial Sequence: Synthetic oligonucleotide
gctgaggatgttggggtttattactgcdtsswmgcactccagacttwcacttttggcggagggaccaag

SEQ ID NO: 565 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagacttwcacttttggcggagggaccaag

SEQ ID NO: 566 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmacttwcacttttggcggagggaccaag

SEQ ID NO: 567 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbctwcacttttggcggagggaccaag

SEQ ID NO: 568 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmacttwcacttttggcggagggaccaag

SEQ ID NO: 569 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbctwcacttttggcggagggaccaag

SEQ ID NO: 570 - DNA, 69 bp, Artificial Sequence
  Description of Artificial Sequence: Synthetic oligonucleotide
gctgaggatgttggggtttattactgcatgcaggcactcsrmvbctwcacttttggcggagggaccaag

SEQ ID NO: 571 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagacttwcacttttggcggagggaccaag

SEQ ID NO: 572 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagacttwcacttttggcggagggaccaag

SEQ ID NO: 573 - DNA, 69 bp, Artificial Sequence
  Description of Artificial Sequence: Synthetic oligonucleotide
gctgaggatgttggggtttattactgcdtscaggcactcsrmacttwcacttttggcggagggaccaag

SEQ ID NO: 574 - DNA, 69 bp, Artificial Sequence
  Description of Artificial Sequence: Synthetic oligonucleotide
gctgaggatgttggggtttattactgcdtscaggcactccagvbctwcacttttggcggagggaccaag

SEQ ID NO: 575 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagacttwcacttttggcggagggaccaag

SEQ ID NO: 576 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagacttwcacttttggcggagggaccaag

SEQ ID NO: 577 - DNA, 69 bp, Artificial Sequence
  Description of Artificial Sequence: Synthetic oligonucleotide
gctgaggatgttggggtttattactgcatgswmgcactcsrmacttwcacttttggcggagggaccaag

SEQ ID NO: 578 - DNA, 69 bp, Artificial Sequence
  Description of Artificial Sequence: Synthetic oligonucleotide
gctgaggatgttggggtttattactgcatgswmgcactccagvbctwcacttttggcggagggaccaag

SEQ ID NO: 579 - DNA, 69 bp, Artificial Sequence
  Description of Artificial Sequence: Synthetic oligonucleotide
gctgaggatgttggggtttattactgcdtsswmgcactccagactmtcacttttggcggagggaccaag

SEQ ID NO: 580 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactmtcacttttggcggagggaccaag

SEQ ID NO: 581 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactmtcacttttggcggagggaccaag

SEQ ID NO: 582 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbcmtcacttttggcggagggaccaag

SEQ ID NO: 583 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactmtcacttttggcggagggaccaag

SEQ ID NO: 584 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbcmtcacttttggcggagggaccaag

SEQ ID NO: 585 - DNA, 69 bp, Artificial Sequence
  Description of Artificial Sequence: Synthetic oligonucleotide
gctgaggatgttggggtttattactgcatgcaggcactcsrmvbcmtcacttttggcggagggaccaag

SEQ ID NO: 586 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactmtcacttttggcggagggaccaag

SEQ ID NO: 587 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactmtcacttttggcggagggaccaag

SEQ ID NO: 588 - DNA, 69 bp, Artificial Sequence
  Description of Artificial Sequence: Synthetic oligonucleotide
gctgaggatgttggggtttattactgcdtscaggcactcsrmactmtcacttttggcggagggaccaag

SEQ ID NO: 589 - DNA, 69 bp, Artificial Sequence
  Description of Artificial Sequence: Synthetic oligonucleotide
gctgaggatgttggggtttattactgcdtscaggcactccagvbcmtcacttttggcggagggaccaag

SEQ ID NO: 590 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactmtcacttttggcggagggaccaag

SEQ ID NO: 591 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactmtcacttttggcggagggaccaag

SEQ ID NO: 592 - DNA, 69 bp, Artificial Sequence
  Description of Artificial Sequence: Synthetic oligonucleotide
gctgaggatgttggggtttattactgcatgswmgcactcsrmactmtcacttttggcggagggaccaag

SEQ ID NO: 593 - DNA, 69 bp, Artificial Sequence
  Description of Artificial Sequence: Synthetic oligonucleotide
gctgaggatgttggggtttattactgcatgswmgcactccagvbcmtcacttttggcggagggaccaag

SEQ ID NO: 594 - DNA, 69 bp, Artificial Sequence
  Description of Artificial Sequence: Synthetic oligonucleotide
gctgaggatgttggggtttattactgcdtsswmgcactccagactwggacttttggcggagggaccaag

SEQ ID NO: 595 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactwggacttttggcggagggaccaag

SEQ ID NO: 596 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactwggacttttggcggagggaccaag

SEQ ID NO: 597 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbcwggacttttggcggagggaccaag

SEQ ID NO: 598 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactwggacttttggcggagggaccaag

SEQ ID NO: 599 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbcwggacttttggcggagggaccaag

SEQ ID NO: 600 - DNA, 69 bp, Artificial Sequence
  Description of Artificial Sequence: Synthetic oligonucleotide
gctgaggatgttggggtttattactgcatgcaggcactcsrmvbcwggacttttggcggagggaccaag

SEQ ID NO: 601 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactwggacttttggcggagggaccaag

SEQ ID NO: 602 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactwggacttttggcggagggaccaag

SEQ ID NO: 603 - DNA, 69 bp, Artificial Sequence
  Description of Artificial Sequence: Synthetic oligonucleotide
gctgaggatgttggggtttattactgcdtscaggcactcsrmactwggacttttggcggagggaccaag

SEQ ID NO: 604 - DNA, 69 bp, Artificial Sequence
  Description of Artificial Sequence: Synthetic oligonucleotide
gctgaggatgttggggtttattactgcdtscaggcactccagvbcwggacttttggcggagggaccaag

SEQ ID NO: 605 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactwggacttttggcggagggaccaag

SEQ ID NO: 606 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactwggacttttggcggagggaccaag

SEQ ID NO: 607 - DNA, 69 bp, Artificial Sequence
  Description of Artificial Sequence: Synthetic oligonucleotide
gctgaggatgttggggtttattactgcatgswmgcactcsrmactwggacttttggcggagggaccaag

SEQ ID NO: 608 - DNA, 69 bp, Artificial Sequence
  Description of Artificial Sequence: Synthetic oligonucleotide
gctgaggatgttggggtttattactgcatgswmgcactccagvbcwggacttttggcggagggaccaag

SEQ ID NO: 609 - DNA, 69 bp, Artificial Sequence
  Description of Artificial Sequence: Synthetic oligonucleotide
gctgaggatgttggggtttattactgcdtsswmgcactccagactcctacttttggcggagggaccaag

SEQ ID NO: 610 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctacttttggcggagggaccaag

SEQ ID NO: 611 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctacttttggcggagggaccaag

SEQ ID NO: 612 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctacttttggcggagggaccaag

SEQ ID NO: 613 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctacttttggcggagggaccaag

SEQ ID NO: 614 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctacttttggcggagggaccaag

SEQ ID NO: 615 - DNA, 69 bp, Artificial Sequence
  Description of Artificial Sequence: Synthetic oligonucleotide
gctgaggatgttggggtttattactgcatgcaggcactcsrmvbccctacttttggcggagggaccaag

SEQ ID NO: 616 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctacttttggcggagggaccaag

SEQ ID NO: 617 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctacttttggcggagggaccaag

SEQ ID NO: 618 - DNA, 69 bp, Artificial Sequence
  Description of Artificial Sequence: Synthetic oligonucleotide
gctgaggatgttggggtttattactgcdtscaggcactcsrmactcctacttttggcggagggaccaag

SEQ ID NO: 619 - DNA, 69 bp, Artificial Sequence
  Description of Artificial Sequence: Synthetic oligonucleotide
gctgaggatgttggggtttattactgcdtscaggcactccagvbccctacttttggcggagggaccaag

SEQ ID NO: 620 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctacttttggcggagggaccaag

SEQ ID NO: 621 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctacttttggcggagggaccaag

SEQ ID NO: 622 - DNA, 69 bp, Artificial Sequence
  Description of Artificial Sequence: Synthetic oligonucleotide
gctgaggatgttggggtttattactgcatgswmgcactcsrmactcctacttttggcggagggaccaag

SEQ ID NO: 623 - DNA, 69 bp, Artificial Sequence
  Description of Artificial Sequence: Synthetic oligonucleotide
gctgaggatgttggggtttattactgcatgswmgcactccagvbccctacttttggcggagggaccaag

SEQ ID NO: 624 - DNA, 69 bp, Artificial Sequence
  Description of Artificial Sequence: Synthetic oligonucleotide
cctgaagattttgcagtttattactgtswmswmagaagtaattggtwcacttttggcggagggaccaag

SEQ ID NO: 625 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggtwcacttttggcggagggaccaag

SEQ ID NO: 626 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggtwcacttttggcggagggaccaag

SEQ ID NO: 627 - DNA, 69 bp, Artificial Sequence
  Description of Artificial Sequence: Synthetic oligonucleotide
cctgaagattttgcagtttattactgtcagcagbhcagtaatywctwcacttttggcggagggaccaag

SEQ ID NO: 628 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggtwcacttttggcggagggaccaag

SEQ ID NO: 629 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywctwcacttttggcggagggaccaag

SEQ ID NO: 630 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywctwcacttttggcggagggaccaag

SEQ ID NO: 631 - DNA, 69 bp, Artificial Sequence
  Description of Artificial Sequence: Synthetic oligonucleotide
cctgaagattttgcagtttattactgtswmcagbhcagtaattggtwcacttttggcggagggaccaag

SEQ ID NO: 632 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggtwcacttttggcggagggaccaag

SEQ ID NO: 633 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggtwcacttttggcggagggaccaag

SEQ ID NO: 634 - DNA, 69 bp, Artificial Sequence
  Description of Artificial Sequence: Synthetic oligonucleotide
cctgaagattttgcagtttattactgtswmcagagaagtaatywctwcacttttggcggagggaccaag

SEQ ID NO: 635 - DNA, 69 bp, Artificial Sequence
  Description of Artificial Sequence: Synthetic oligonucleotide
cctgaagattttgcagtttattactgtcagswmbhcagtaattggtwcacttttggcggagggaccaag

SEQ ID NO: 636 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggtwcacttttggcggagggaccaag

SEQ ID NO: 637 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggtwcacttttggcggagggaccaag

SEQ ID NO: 638 - DNA, 69 bp, Artificial Sequence
  Description of Artificial Sequence: Synthetic oligonucleotide
cctgaagattttgcagtttattactgtcagswmagaagtaatywctwcacttttggcggagggaccaag

SEQ ID NO: 639 - DNA, 69 bp, Artificial Sequence
  Description of Artificial Sequence: Synthetic oligonucleotide
cctgaagattttgcagtttattactgtswmswmagaagtaattggmtcacttttggcggagggaccaag

SEQ ID NO: 640 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggmtcacttttggcggagggaccaag

SEQ ID NO: 641 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggmtcacttttggcggagggaccaag

SEQ ID NO: 642 - DNA, 69 bp, Artificial Sequence
  Description of Artificial Sequence: Synthetic oligonucleotide
cctgaagattttgcagtttattactgtcagcagbhcagtaatywcmtcacttttggcggagggaccaag

SEQ ID NO: 643 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggmtcacttttggcggagggaccaag

SEQ ID NO: 644 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywcmtcacttttggcggagggaccaag

SEQ ID NO: 645 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywcmtcacttttggcggagggaccaag

SEQ ID NO: 646 - DNA, 69 bp, Artificial Sequence
  Description of Artificial Sequence: Synthetic oligonucleotide
cctgaagattttgcagtttattactgtswmcagbhcagtaattggmtcacttttggcggagggaccaag

SEQ ID NO: 647 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggmtcacttttggcggagggaccaag

SEQ ID NO: 648 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggmtcacttttggcggagggaccaag

SEQ ID NO: 649 - DNA, 69 bp, Artificial Sequence
  Description of Artificial Sequence: Synthetic oligonucleotide
cctgaagattttgcagtttattactgtswmcagagaagtaatywcmtcacttttggcggagggaccaag

SEQ ID NO: 650 - DNA, 69 bp, Artificial Sequence
  Description of Artificial Sequence: Synthetic oligonucleotide
cctgaagattttgcagtttattactgtcagswmbhcagtaattggmtcacttttggcggagggaccaag

SEQ ID NO: 651 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggmtcacttttggcggagggaccaag

SEQ ID NO: 652 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggmtcacttttggcggagggaccaag

SEQ ID NO: 653 - DNA, 69 bp, Artificial Sequence
  Description of Artificial Sequence: Synthetic oligonucleotide
cctgaagattttgcagtttattactgtcagswmagaagtaatywcmtcacttttggcggagggaccaag

SEQ ID NO: 654 - DNA, 69 bp, Artificial Sequence
  Description of Artificial Sequence: Synthetic oligonucleotide
cctgaagattttgcagtttattactgtswmswmagaagtaattggwggacttttggcggagggaccaag

SEQ ID NO: 655 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggwggacttttggcggagggaccaag

SEQ ID NO: 656 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggwggacttttggcggagggaccaag

SEQ ID NO: 657 - DNA, 69 bp, Artificial Sequence
  Description of Artificial Sequence: Synthetic oligonucleotide
cctgaagattttgcagtttattactgtcagcagbhcagtaatywcwggacttttggcggagggaccaag

SEQ ID NO: 658 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggwggacttttggcggagggaccaag

SEQ ID NO: 659 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywcwggacttttggcggagggaccaag

SEQ ID NO: 660 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywcwggacttttggcggagggaccaag

SEQ ID NO: 661 - DNA, 69 bp, Artificial Sequence
  Description of Artificial Sequence: Synthetic oligonucleotide
cctgaagattttgcagtttattactgtswmcagbhcagtaattggwggacttttggcggagggaccaag

SEQ ID NO: 662 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggwggacttttggcggagggaccaag

SEQ ID NO: 663 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggwggacttttggcggagggaccaag

SEQ ID NO: 664 - DNA, 69 bp, Artificial Sequence
  Description of Artificial Sequence: Synthetic oligonucleotide
cctgaagattttgcagtttattactgtswmcagagaagtaatywcwggacttttggcggagggaccaag

SEQ ID NO: 665 - DNA, 69 bp, Artificial Sequence
  Description of Artificial Sequence: Synthetic oligonucleotide
cctgaagattttgcagtttattactgtcagswmbhcagtaattggwggacttttggcggagggaccaag

SEQ ID NO: 666 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggwggacttttggcggagggaccaag

SEQ ID NO: 667 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggwggacttttggcggagggaccaag

SEQ ID NO: 668 - DNA, 69 bp, Artificial Sequence
  Description of Artificial Sequence: Synthetic oligonucleotide
cctgaagattttgcagtttattactgtcagswmagaagtaatywcwggacttttggcggagggaccaag

SEQ ID NO: 669 - DNA, 69 bp, Artificial Sequence
  Description of Artificial Sequence: Synthetic oligonucleotide
cctgaagattttgcagtttattactgtswmswmagaagtaattggcctacttttggcggagggaccaag

SEQ ID NO: 670 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctacttttggcggagggaccaag

SEQ ID NO: 671 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctacttttggcggagggaccaag

SEQ ID NO: 672 - DNA, 69 bp, Artificial Sequence
  Description of Artificial Sequence: Synthetic oligonucleotide
cctgaagattttgcagtttattactgtcagcagbhcagtaatywccctacttttggcggagggaccaag

SEQ ID NO: 673 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctacttttggcggagggaccaag

SEQ ID NO: 674 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctacttttggcggagggaccaag

SEQ ID NO: 675 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctacttttggcggagggaccaag

SEQ ID NO: 676 - DNA, 69 bp, Artificial Sequence
  Description of Artificial Sequence: Synthetic oligonucleotide
cctgaagattttgcagtttattactgtswmcagbhcagtaattggcctacttttggcggagggaccaag

SEQ ID NO: 677 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctacttttggcggagggaccaag

SEQ ID NO: 678 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctacttttggcggagggaccaag

SEQ ID NO: 679 - DNA, 69 bp, Artificial Sequence
  Description of Artificial Sequence: Synthetic oligonucleotide
cctgaagattttgcagtttattactgtswmcagagaagtaatywccctacttttggcggagggaccaag

SEQ ID NO: 680 - DNA, 69 bp, Artificial Sequence
  Description of Artificial Sequence: Synthetic oligonucleotide
cctgaagattttgcagtttattactgtcagswmbhcagtaattggcctacttttggcggagggaccaag

SEQ ID NO: 681 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctacttttggcggagggaccaag

SEQ ID NO: 682 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctacttttggcggagggaccaag

SEQ ID NO: 683 - DNA, 69 bp, Artificial Sequence
  Description of Artificial Sequence: Synthetic oligonucleotide
cctgaagattttgcagtttattactgtcagswmagaagtaatywccctacttttggcggagggaccaag

SEQ ID NO: 684 - DNA, 72 bp, Artificial Sequence
  Description of Artificial Sequence: Synthetic oligonucleotide
cagtctgaagattttgcagtttattactgtswmswmtacaataattggtwcacttttggcggagggaccaag

SEQ ID NO: 685 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggtwcacttttggcggagggaccaag

SEQ ID NO: 686 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggtwcacttttggcggagggaccaag

SEQ ID NO: 687 - DNA, 72 bp, Artificial Sequence
  Description of Artificial Sequence: Synthetic oligonucleotide
cagtctgaagattttgcagtttattactgtcagcagbhcaataatywctwcacttttggcggagggaccaag

SEQ ID NO: 688 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggtwcacttttggcggagggaccaag

SEQ ID NO: 689 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywctwcacttttggcggagggaccaag

SEQ ID NO: 690 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywctwcacttttggcggagggaccaag

SEQ ID NO: 691 - DNA, 72 bp, Artificial Sequence
  Description of Artificial Sequence: Synthetic oligonucleotide
cagtctgaagattttgcagtttattactgtswmcagbhcaataattggtwcacttttggcggagggaccaag

SEQ ID NO: 692 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggtwcacttttggcggagggaccaag

SEQ ID NO: 693 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggtwcacttttggcggagggaccaag

SEQ ID NO: 694 - DNA, 72 bp, Artificial Sequence
  Description of Artificial Sequence: Synthetic oligonucleotide
cagtctgaagattttgcagtttattactgtswmcagtacaataatywctwcacttttggcggagggaccaag

SEQ ID NO: 695 - DNA, 72 bp, Artificial Sequence
  Description of Artificial Sequence: Synthetic oligonucleotide
cagtctgaagattttgcagtttattactgtcagswmbhcaataattggtwcacttttggcggagggaccaag

SEQ ID NO: 696 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggtwcacttttggcggagggaccaag

SEQ ID NO: 697 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggtwcacttttggcggagggaccaag

SEQ ID NO: 698 - DNA, 72 bp, Artificial Sequence
  Description of Artificial Sequence: Synthetic oligonucleotide
cagtctgaagattttgcagtttattactgtcagswmtacaataatywctwcacttttggcggagggaccaag

SEQ ID NO: 699 - DNA, 72 bp, Artificial Sequence
  Description of Artificial Sequence: Synthetic oligonucleotide
cagtctgaagattttgcagtttattactgtswmswmtacaataattggmtcacttttggcggagggaccaag

SEQ ID NO: 700 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggmtcacttttggcggagggaccaag

SEQ ID NO: 701 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggmtcacttttggcggagggaccaag

SEQ ID NO: 702 - DNA, 72 bp, Artificial Sequence
  Description of Artificial Sequence: Synthetic oligonucleotide
cagtctgaagattttgcagtttattactgtcagcagbhcaataatywcmtcacttttggcggagggaccaag

SEQ ID NO: 703 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggmtcacttttggcggagggaccaag

SEQ ID NO: 704 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywcmtcacttttggcggagggaccaag

SEQ ID NO: 705 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywcmtcacttttggcggagggaccaag

SEQ ID NO: 706 - DNA, 72 bp, Artificial Sequence
  Description of Artificial Sequence: Synthetic oligonucleotide
cagtctgaagattttgcagtttattactgtswmcagbhcaataattggmtcacttttggcggagggaccaag

SEQ ID NO: 707 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggmtcacttttggcggagggaccaag

SEQ ID NO: 708 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggmtcacttttggcggagggaccaag

SEQ ID NO: 709 - DNA, 72 bp, Artificial Sequence
  Description of Artificial Sequence: Synthetic oligonucleotide
cagtctgaagattttgcagtttattactgtswmcagtacaataatywcmtcacttttggcggagggaccaag

SEQ ID NO: 710 - DNA, 72 bp, Artificial Sequence
  Description of Artificial Sequence: Synthetic oligonucleotide
cagtctgaagattttgcagtttattactgtcagswmbhcaataattggmtcacttttggcggagggaccaag

SEQ ID NO: 711 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggmtcacttttggcggagggaccaag

SEQ ID NO: 712 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggmtcacttttggcggagggaccaag

SEQ ID NO: 713 - DNA, 72 bp, Artificial Sequence
  Description of Artificial Sequence: Synthetic oligonucleotide
cagtctgaagattttgcagtttattactgtcagswmtacaataatywcmtcacttttggcggagggaccaag

SEQ ID NO: 714 - DNA, 72 bp, Artificial Sequence
  Description of Artificial Sequence: Synthetic oligonucleotide
cagtctgaagattttgcagtttattactgtswmswmtacaataattggwggacttttggcggagggaccaag

SEQ ID NO: 715 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggwggacttttggcggagggaccaag

SEQ ID NO: 716 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggwggacttttggcggagggaccaag

SEQ ID NO: 717 - DNA, 72 bp, Artificial Sequence
  Description of Artificial Sequence: Synthetic oligonucleotide
cagtctgaagattttgcagtttattactgtcagcagbhcaataatywcwggacttttggcggagggaccaag

SEQ ID NO: 718 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggwggacttttggcggagggaccaag

SEQ ID NO: 719 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywcwggacttttggcggagggaccaag

SEQ ID NO: 720 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywcwggacttttggcggagggaccaag

SEQ ID NO: 721 - DNA, 72 bp, Artificial Sequence
  Description of Artificial Sequence: Synthetic oligonucleotide
cagtctgaagattttgcagtttattactgtswmcagbhcaataattggwggacttttggcggagggaccaag

SEQ ID NO: 722 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggwggacttttggcggagggaccaag

SEQ ID NO: 723 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggwggacttttggcggagggaccaag

SEQ ID NO: 724 - DNA, 72 bp, Artificial Sequence
  Description of Artificial Sequence: Synthetic oligonucleotide
cagtctgaagattttgcagtttattactgtswmcagtacaataatywcwggacttttggcggagggaccaag

SEQ ID NO: 725 - DNA, 72 bp, Artificial Sequence
  Description of Artificial Sequence: Synthetic oligonucleotide
cagtctgaagattttgcagtttattactgtcagswmbhcaataattggwggacttttggcggagggaccaag

SEQ ID NO: 726 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggwggacttttggcggagggaccaag

SEQ ID NO: 727 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggwggacttttggcggagggaccaag

SEQ ID NO: 728 - DNA, 72 bp, Artificial Sequence
  Description of Artificial Sequence: Synthetic oligonucleotide
cagtctgaagattttgcagtttattactgtcagswmtacaataatywcwggacttttggcggagggaccaag

SEQ ID NO: 729 - DNA, 72 bp, Artificial Sequence
  Description of Artificial Sequence: Synthetic oligonucleotide
cagtctgaagattttgcagtttattactgtswmswmtacaataattggcctacttttggcggagggaccaag

SEQ ID NO: 730 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctacttttggcggagggaccaag

SEQ ID NO: 731 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctacttttggcggagggaccaag

SEQ ID NO: 732 - DNA, 72 bp, Artificial Sequence
  Description of Artificial Sequence: Synthetic oligonucleotide
cagtctgaagattttgcagtttattactgtcagcagbhcaataatywccctacttttggcggagggaccaag

SEQ ID NO: 733 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctacttttggcggagggaccaag

SEQ ID NO: 734 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctacttttggcggagggaccaag

SEQ ID NO: 735 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctacttttggcggagggaccaag

SEQ ID NO: 736 - DNA, 72 bp, Artificial Sequence
  Description of Artificial Sequence: Synthetic oligonucleotide
cagtctgaagattttgcagtttattactgtswmcagbhcaataattggcctacttttggcggagggaccaag

SEQ ID NO: 737 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctacttttggcggagggaccaag

SEQ ID NO: 738 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctacttttggcggagggaccaag

SEQ ID NO: 739 - DNA, 72 bp, Artificial Sequence
  Description of Artificial Sequence: Synthetic oligonucleotide
cagtctgaagattttgcagtttattactgtswmcagtacaataatywccctacttttggcggagggaccaag

SEQ ID NO: 740 - DNA, 72 bp, Artificial Sequence
  Description of Artificial Sequence: Synthetic oligonucleotide
cagtctgaagattttgcagtttattactgtcagswmbhcaataattggcctacttttggcggagggaccaag

SEQ ID NO: 741 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctacttttggcggagggaccaag

SEQ ID NO: 742 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctacttttggcggagggaccaag

SEQ ID NO: 743 - DNA, 72 bp, Artificial Sequence
  Description of Artificial Sequence: Synthetic oligonucleotide
cagtctgaagattttgcagtttattactgtcagswmtacaataatywccctacttttggcggagggaccaag

SEQ ID NO: 744 - DNA, 69 bp, Artificial Sequence
  Description of Artificial Sequence: Synthetic oligonucleotide
cctgaagattttgcagtgtattactgtswmswmtacggaagtagttwcacttttggcggagggaccaag

SEQ ID NO: 745 - DNA, 69 bp, Artificial Sequence
  Description of Artificial Sequence: Synthetic oligonucleotide
cctgaagattttgcagtgtattactgtcagcagbhcbhcagtagttwcacttttggcggagggaccaag

SEQ ID NO: 746 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagttwcacttttggcggagggaccaag

SEQ ID NO: 747 - DNA, 69 bp, Artificial Sequence
  Description of Artificial Sequence: Synthetic oligonucleotide
cctgaagattttgcagtgtattactgtcagcagbhcggaagtbhctwcacttttggcggagggaccaag

SEQ ID NO: 748 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagttwcacttttggcggagggaccaag

SEQ ID NO: 749 - DNA, 69 bp, Artificial Sequence
  Description of Artificial Sequence: Synthetic oligonucleotide
cctgaagattttgcagtgtattactgtcagcagtacbhcagtbhctwcacttttggcggagggaccaag

SEQ ID NO: 750 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhctwcacttttggcggagggaccaag

SEQ ID NO: 751 - DNA, 69 bp, Artificial Sequence
  Description of Artificial Sequence: Synthetic oligonucleotide
cctgaagattttgcagtgtattactgtswmcagbhcggaagtagttwcacttttggcggagggaccaag

SEQ ID NO: 752 - DNA, 69 bp, Artificial Sequence
  Description of Artificial Sequence: Synthetic oligonucleotide
cctgaagattttgcagtgtattactgtswmcagtacbhcagtagttwcacttttggcggagggaccaag

SEQ ID NO: 753 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagttwcacttttggcggagggaccaag

SEQ ID NO: 754 - DNA, 69 bp, Artificial Sequence
  Description of Artificial Sequence: Synthetic oligonucleotide
cctgaagattttgcagtgtattactgtswmcagtacggaagtbhctwcacttttggcggagggaccaag

SEQ ID NO: 755 - DNA, 69 bp, Artificial Sequence
  Description of Artificial Sequence: Synthetic oligonucleotide
cctgaagattttgcagtgtattactgtcagswmbhcggaagtagttwcacttttggcggagggaccaag

SEQ ID NO: 756 - DNA, 69 bp, Artificial Sequence
  Description of Artificial Sequence: Synthetic oligonucleotide
cctgaagattttgcagtgtattactgtcagswmtacbhcagtagttwcacttttggcggagggaccaag

SEQ ID NO: 757 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagttwcacttttggcggagggaccaag

SEQ ID NO: 758 - DNA, 69 bp, Artificial Sequence
  Description of Artificial Sequence: Synthetic oligonucleotide
cctgaagattttgcagtgtattactgtcagswmtacggaagtbhctwcacttttggcggagggaccaag

SEQ ID NO: 759 - DNA, 69 bp, Artificial Sequence
  Description of Artificial Sequence: Synthetic oligonucleotide
cctgaagattttgcagtgtattactgtswmswmtacggaagtagtmtcacttttggcggagggaccaag

SEQ ID NO: 760 - DNA, 69 bp, Artificial Sequence
  Description of Artificial Sequence: Synthetic oligonucleotide
cctgaagattttgcagtgtattactgtcagcagbhcbhcagtagtmtcacttttggcggagggaccaag

SEQ ID NO: 761 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtmtcacttttggcggagggaccaag

SEQ ID NO: 762 - DNA, 69 bp, Artificial Sequence
  Description of Artificial Sequence: Synthetic oligonucleotide
cctgaagattttgcagtgtattactgtcagcagbhcggaagtbhcmtcacttttggcggagggaccaag

SEQ ID NO: 763 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtmtcacttttggcggagggaccaag

SEQ ID NO: 764 - DNA, 69 bp, Artificial Sequence
  Description of Artificial Sequence: Synthetic oligonucleotide
cctgaagattttgcagtgtattactgtcagcagtacbhcagtbhcmtcacttttggcggagggaccaag

SEQ ID NO: 765 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhcmtcacttttggcggagggaccaag

SEQ ID NO: 766 - DNA, 69 bp, Artificial Sequence
  Description of Artificial Sequence: Synthetic oligonucleotide
cctgaagattttgcagtgtattactgtswmcagbhcggaagtagtmtcacttttggcggagggaccaag

SEQ ID NO: 767 - DNA, 69 bp, Artificial Sequence
  Description of Artificial Sequence: Synthetic oligonucleotide
cctgaagattttgcagtgtattactgtswmcagtacbhcagtagtmtcacttttggcggagggaccaag

SEQ ID NO: 768 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtmtcacttttggcggagggaccaag

SEQ ID NO: 769 - DNA, 69 bp, Artificial Sequence
  Description of Artificial Sequence: Synthetic oligonucleotide
cctgaagattttgcagtgtattactgtswmcagtacggaagtbhcmtcacttttggcggagggaccaag

SEQ ID NO: 770 - DNA, 69 bp, Artificial Sequence
  Description of Artificial Sequence: Synthetic oligonucleotide
cctgaagattttgcagtgtattactgtcagswmbhcggaagtagtmtcacttttggcggagggaccaag

SEQ ID NO: 771 - DNA, 69 bp, Artificial Sequence
  Description of Artificial Sequence: Synthetic oligonucleotide
cctgaagattttgcagtgtattactgtcagswmtacbhcagtagtmtcacttttggcggagggaccaag

SEQ ID NO: 772 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtmtcacttttggcggagggaccaag

SEQ ID NO: 773 - DNA, 69 bp, Artificial Sequence
  Description of Artificial Sequence: Synthetic oligonucleotide
cctgaagattttgcagtgtattactgtcagswmtacggaagtbhcmtcacttttggcggagggaccaag

SEQ ID NO: 774 - DNA, 69 bp, Artificial Sequence
  Description of Artificial Sequence: Synthetic oligonucleotide
cctgaagattttgcagtgtattactgtswmswmtacggaagtagtwggacttttggcggagggaccaag

SEQ ID NO: 775 - DNA, 69 bp, Artificial Sequence
  Description of Artificial Sequence: Synthetic oligonucleotide
cctgaagattttgcagtgtattactgtcagcagbhcbhcagtagtwggacttttggcggagggaccaag

SEQ ID NO: 776 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtwggacttttggcggagggaccaag

SEQ ID NO: 777 - DNA, 69 bp, Artificial Sequence
  Description of Artificial Sequence: Synthetic oligonucleotide
cctgaagattttgcagtgtattactgtcagcagbhcggaagtbhcwggacttttggcggagggaccaag

SEQ ID NO: 778 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtwggacttttggcggagggaccaag

SEQ ID NO: 779 - DNA, 69 bp, Artificial Sequence
  Description of Artificial Sequence: Synthetic oligonucleotide
cctgaagattttgcagtgtattactgtcagcagtacbhcagtbhcwggacttttggcggagggaccaag

SEQ ID NO: 780 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhcwggacttttggcggagggaccaag

SEQ ID NO: 781 - DNA, 69 bp, Artificial Sequence
  Description of Artificial Sequence: Synthetic oligonucleotide
cctgaagattttgcagtgtattactgtswmcagbhcggaagtagtwggacttttggcggagggaccaag

SEQ ID NO: 782 - DNA, 69 bp, Artificial Sequence
  Description of Artificial Sequence: Synthetic oligonucleotide
cctgaagattttgcagtgtattactgtswmcagtacbhcagtagtwggacttttggcggagggaccaag

SEQ ID NO: 783 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtwggacttttggcggagggaccaag

SEQ ID NO: 784 - DNA, 69 bp, Artificial Sequence
  Description of Artificial Sequence: Synthetic oligonucleotide
cctgaagattttgcagtgtattactgtswmcagtacggaagtbhcwggacttttggcggagggaccaag

SEQ ID NO: 785 - DNA, 69 bp, Artificial Sequence
  Description of Artificial Sequence: Synthetic oligonucleotide
cctgaagattttgcagtgtattactgtcagswmbhcggaagtagtwggacttttggcggagggaccaag

SEQ ID NO: 786 - DNA, 69 bp, Artificial Sequence
  Description of Artificial Sequence: Synthetic oligonucleotide
cctgaagattttgcagtgtattactgtcagswmtacbhcagtagtwggacttttggcggagggaccaag

SEQ ID NO: 787 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtwggacttttggcggagggaccaag

SEQ ID NO: 788 - DNA, 69 bp, Artificial Sequence
  Description of Artificial Sequence: Synthetic oligonucleotide
cctgaagattttgcagtgtattactgtcagswmtacggaagtbhcwggacttttggcggagggaccaag

SEQ ID NO: 789 - DNA, 69 bp, Artificial Sequence
  Description of Artificial Sequence: Synthetic oligonucleotide
cctgaagattttgcagtgtattactgtswmswmtacggaagtagtcctacttttggcggagggaccaag

SEQ ID NO: 790 - DNA, 69 bp, Artificial Sequence
  Description of Artificial Sequence: Synthetic oligonucleotide
cctgaagattttgcagtgtattactgtcagcagbhcbhcagtagtcctacttttggcggagggaccaag

SEQ ID NO: 791 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctacttttggcggagggaccaag

SEQ ID NO: 792 - DNA, 69 bp, Artificial Sequence
  Description of Artificial Sequence: Synthetic oligonucleotide
cctgaagattttgcagtgtattactgtcagcagbhcggaagtbhccctacttttggcggagggaccaag

SEQ ID NO: 793 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctacttttggcggagggaccaag

SEQ ID NO: 794 - DNA, 69 bp, Artificial Sequence
  Description of Artificial Sequence: Synthetic oligonucleotide
cctgaagattttgcagtgtattactgtcagcagtacbhcagtbhccctacttttggcggagggaccaag

SEQ ID NO: 795 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctacttttggcggagggaccaag

SEQ ID NO: 796 - DNA, 69 bp, Artificial Sequence
  Description of Artificial Sequence: Synthetic oligonucleotide
cctgaagattttgcagtgtattactgtswmcagbhcggaagtagtcctacttttggcggagggaccaag

SEQ ID NO: 797 - DNA, 69 bp, Artificial Sequence
  Description of Artificial Sequence: Synthetic oligonucleotide
cctgaagattttgcagtgtattactgtswmcagtacbhcagtagtcctacttttggcggagggaccaag

SEQ ID NO: 798 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctacttttggcggagggaccaag

SEQ ID NO: 799 - DNA, 69 bp, Artificial Sequence
  Description of Artificial Sequence: Synthetic oligonucleotide
cctgaagattttgcagtgtattactgtswmcagtacggaagtbhccctacttttggcggagggaccaag

SEQ ID NO: 800 - DNA, 69 bp, Artificial Sequence
  Description of Artificial Sequence: Synthetic oligonucleotide
cctgaagattttgcagtgtattactgtcagswmbhcggaagtagtcctacttttggcggagggaccaag

SEQ ID NO: 801 - DNA, 69 bp, Artificial Sequence
  Description of Artificial Sequence: Synthetic oligonucleotide
cctgaagattttgcagtgtattactgtcagswmtacbhcagtagtcctacttttggcggagggaccaag

SEQ ID NO: 802 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctacttttggcggagggaccaag

SEQ ID NO: 803 - DNA, 69 bp, Artificial Sequence
  Description of Artificial Sequence: Synthetic oligonucleotide
cctgaagattttgcagtgtattactgtcagswmtacggaagtbhccctacttttggcggagggaccaag

SEQ ID NO: 804 - DNA, 69 bp, Artificial Sequence
  Description of Artificial Sequence: Synthetic oligonucleotide
cctgatgattttgcaacttattactgccagcagbhcvrmmbctactwcacttttggcggagggaccaag

SEQ ID NO: 805 - DNA, 69 bp, Artificial Sequence
  Description of Artificial Sequence: Synthetic oligonucleotide
cctgatgattttgcaacttattactgccagcagbhcvrmmbctacmtcacttttggcggagggaccaag

SEQ ID NO: 806 - DNA, 69 bp, Artificial Sequence
  Description of Artificial Sequence: Synthetic oligonucleotide
cctgatgattttgcaacttattactgccagcagbhcvrmmbctacwggacttttggcggagggaccaag

SEQ ID NO: 807 - DNA, 69 bp, Artificial Sequence
  Description of Artificial Sequence: Synthetic oligonucleotide
cctgatgattttgcaacttattactgccagcagbhcvrmmbctacyctacttttggcggagggaccaag

SEQ ID NO: 808 - DNA, 69 bp, Artificial Sequence
  Description of Artificial Sequence: Synthetic oligonucleotide
cctgatgattttgcaacttattactgccagcagbhcaatmbcywctwcacttttggcggagggaccaag

SEQ ID NO: 809 - DNA, 69 bp, Artificial Sequence
  Description of Artificial Sequence: Synthetic oligonucleotide
cctgatgattttgcaacttattactgccagcagbhcaatmbcywcmtcacttttggcggagggaccaag

SEQ ID NO: 810 - DNA, 69 bp, Artificial Sequence
  Description of Artificial Sequence: Synthetic oligonucleotide
cctgatgattttgcaacttattactgccagcagbhcaatmbcywcwggacttttggcggagggaccaag

SEQ ID NO: 811 - DNA, 69 bp, Artificial Sequence
  Description of Artificial Sequence: Synthetic oligonucleotide
cctgatgattttgcaacttattactgccagcagbhcaatmbcywcyctacttttggcggagggaccaag

SEQ ID NO: 812 - DNA, 69 bp, Artificial Sequence
  Description of Artificial Sequence: Synthetic oligonucleotide
cctgatgattttgcaacttattactgccagcagbhcvrmagtywctwcacttttggcggagggaccaag

SEQ ID NO: 813 - DNA, 69 bp, Artificial Sequence
  Description of Artificial Sequence: Synthetic oligonucleotide
cctgatgattttgcaacttattactgccagcagbhcvrmagtywcmtcacttttggcggagggaccaag

SEQ ID NO: 814 - DNA, 69 bp, Artificial Sequence
  Description of Artificial Sequence: Synthetic oligonucleotide
cctgatgattttgcaacttattactgccagcagbhcvrmagtywcwggacttttggcggagggaccaag

SEQ ID NO: 815 - DNA, 69 bp, Artificial Sequence
  Description of Artificial Sequence: Synthetic oligonucleotide
cctgatgattttgcaacttattactgccagcagbhcvrmagtywcyctacttttggcggagggaccaag

SEQ ID NO: 816 - DNA, 69 bp, Artificial Sequence
  Description of Artificial Sequence: Synthetic oligonucleotide
cctgatgattttgcaacttattactgccagcagtacvrmmbcywctwcacttttggcggagggaccaag

SEQ ID NO: 817 - DNA, 69 bp, Artificial Sequence
  Description of Artificial Sequence: Synthetic oligonucleotide
cctgatgattttgcaacttattactgccagcagtacvrmmbcywcmtcacttttggcggagggaccaag

SEQ ID NO: 818 - DNA, 69 bp, Artificial Sequence
  Description of Artificial Sequence: Synthetic oligonucleotide
cctgatgattttgcaacttattactgccagcagtacvrmmbcywcwggacttttggcggagggaccaag

SEQ ID NO: 819 - DNA, 69 bp, Artificial Sequence
  Description of Artificial Sequence: Synthetic oligonucleotide
cctgatgattttgcaacttattactgccagcagtacvrmmbcywcyctacttttggcggagggaccaag

SEQ ID NO: 820 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttctwcacttttggcggagggaccaag

SEQ ID NO: 821 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttcmtcacttttggcggagggaccaag

SEQ ID NO: 822 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttcwggacttttggcggagggaccaag

SEQ ID NO: 823 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctacttttggcggagggaccaag

SEQ ID NO: 824 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywctwcacttttggcggagggaccaag

SEQ ID NO: 825 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywcmtcacttttggcggagggaccaag

SEQ ID NO: 826 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywcwggacttttggcggagggaccaag

SEQ ID NO: 827 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctacttttggcggagggaccaag

SEQ ID NO: 828 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywctwcacttttggcggagggaccaag

SEQ ID NO: 829 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywcmtcacttttggcggagggaccaag

SEQ ID NO: 830 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywcwggacttttggcggagggaccaag

SEQ ID NO: 831 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctacttttggcggagggaccaag

SEQ ID NO: 832 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywctwcacttttggcggagggaccaag

SEQ ID NO: 833 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywcmtcacttttggcggagggaccaag

SEQ ID NO: 834 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywcwggacttttggcggagggaccaag

SEQ ID NO: 835 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctacttttggcggagggaccaag

SEQ ID NO: 836 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctctwcacttttggcggagggaccaag

SEQ ID NO: 837 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctcmtcacttttggcggagggaccaag

SEQ ID NO: 838 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctcwggacttttggcggagggaccaag

SEQ ID NO: 839 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctacttttggcggagggaccaag

SEQ ID NO: 840 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywctwcacttttggcggagggaccaag

SEQ ID NO: 841 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywcmtcacttttggcggagggaccaag

SEQ ID NO: 842 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywcwggacttttggcggagggaccaag

SEQ ID NO: 843 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctacttttggcggagggaccaag

SEQ ID NO: 844 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywctwcacttttggcggagggaccaag

SEQ ID NO: 845 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywcmtcacttttggcggagggaccaag

SEQ ID NO: 846 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywcwggacttttggcggagggaccaag

SEQ ID NO: 847 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctacttttggcggagggaccaag

SEQ ID NO: 848 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywctwcacttttggcggagggaccaag

SEQ ID NO: 849 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywcmtcacttttggcggagggaccaag

SEQ ID NO: 850 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywcwggacttttggcggagggaccaag

SEQ ID NO: 851 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctacttttggcggagggaccaag

SEQ ID NO: 852 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcacttwcacttttggcggagggaccaag

SEQ ID NO: 853 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactmtcacttttggcggagggaccaag

SEQ ID NO: 854 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactwggacttttggcggagggaccaag

SEQ ID NO: 855 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctacttttggcggagggaccaag

SEQ ID NO: 856 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhctwcacttttggcggagggaccaag

SEQ ID NO: 857 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhcmtcacttttggcggagggaccaag

SEQ ID NO: 858 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhcwggacttttggcggagggaccaag

SEQ ID NO: 859 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctacttttggcggagggaccaag

SEQ ID NO: 860 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhctwcacttttggcggagggaccaag

SEQ ID NO: 861 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhcmtcacttttggcggagggaccaag

SEQ ID NO: 862 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhcwggacttttggcggagggaccaag

SEQ ID NO: 863 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctacttttggcggagggaccaag

SEQ ID NO: 864 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhctwcacttttggcggagggaccaag

SEQ ID NO: 865 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhcmtcacttttggcggagggaccaag

SEQ ID NO: 866 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhcwggacttttggcggagggaccaag

SEQ ID NO: 867 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctacttttggcggagggaccaag

SEQ ID NO: 868 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmacttwcacttttggcggagggaccaag

SEQ ID NO: 869 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactmtcacttttggcggagggaccaag

SEQ ID NO: 870 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactwggacttttggcggagggaccaag

SEQ ID NO: 871 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctacttttggcggagggaccaag

SEQ ID NO: 872 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbctwcacttttggcggagggaccaag

SEQ ID NO: 873 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbcmtcacttttggcggagggaccaag

SEQ ID NO: 874 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbcwggacttttggcggagggaccaag

SEQ ID NO: 875 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctacttttggcggagggaccaag

SEQ ID NO: 876 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbctwcacttttggcggagggaccaag

SEQ ID NO: 877 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbcmtcacttttggcggagggaccaag

SEQ ID NO: 878 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbcwggacttttggcggagggaccaag

SEQ ID NO: 879 - DNA, 69 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctacttttggcggagggaccaag

SEQ ID NO: 880 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbctwcacttttggcggagggaccaag

SEQ ID NO: 881 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbcmtcacttttggcggagggaccaag

SEQ ID NO: 882 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbcwggacttttggcggagggaccaag

SEQ ID NO: 883 - DNA, 69 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctacttttggcggagggaccaag

SEQ ID NO: 884 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggtwcacttttggcggagggaccaag

SEQ ID NO: 885 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggmtcacttttggcggagggaccaag

SEQ ID NO: 886 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggwggacttttggcggagggaccaag

SEQ ID NO: 887 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctacttttggcggagggaccaag

SEQ ID NO: 888 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywctwcacttttggcggagggaccaag

SEQ ID NO: 889 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywcmtcacttttggcggagggaccaag

SEQ ID NO: 890 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywcwggacttttggcggagggaccaag

SEQ ID NO: 891 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctacttttggcggagggaccaag

SEQ ID NO: 892 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywctwcacttttggcggagggaccaag

SEQ ID NO: 893 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywcmtcacttttggcggagggaccaag

SEQ ID NO: 894 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywcwggacttttggcggagggaccaag

SEQ ID NO: 895 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctacttttggcggagggaccaag

SEQ ID NO: 896 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywctwcacttttggcggagggaccaag

SEQ ID NO: 897 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywcmtcacttttggcggagggaccaag

SEQ ID NO: 898 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywcwggacttttggcggagggaccaag

SEQ ID NO: 899 - DNA, 69 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctacttttggcggagggaccaag

SEQ ID NO: 900 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggtwcacttttggcggagggaccaag

SEQ ID NO: 901 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggmtcacttttggcggagggaccaag

SEQ ID NO: 902 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggwggacttttggcggagggaccaag

SEQ ID NO: 903 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctacttttggcggagggaccaag

SEQ ID NO: 904 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywctwcacttttggcggagggaccaag

SEQ ID NO: 905 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywcmtcacttttggcggagggaccaag

SEQ ID NO: 906 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywcwggacttttggcggagggaccaag

SEQ ID NO: 907 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctacttttggcggagggaccaag

SEQ ID NO: 908 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywctwcacttttggcggagggaccaag

SEQ ID NO: 909 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywcmtcacttttggcggagggaccaag

SEQ ID NO: 910 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywcwggacttttggcggagggaccaag

SEQ ID NO: 911 - DNA, 72 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctacttttggcggagggaccaag

SEQ ID NO: 912 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywctwcacttttggcggagggaccaag

SEQ ID NO: 913 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywcmtcacttttggcggagggaccaag

SEQ ID NO: 914 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywcwggacttttggcggagggaccaag

SEQ ID NO: 915 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctacttttggcggagggaccaag

SEQ ID NO: 916 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagttwcacttttggcggagggaccaag

SEQ ID NO: 917 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtmtcacttttggcggagggaccaag

SEQ ID NO: 918 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtwggacttttggcggagggaccaag

SEQ ID NO: 919 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctacttttggcggagggaccaag

SEQ ID NO: 920 - DNA, 69 bp, Artificial Sequence
  Description of Artificial Sequence: Synthetic oligonucleotide
cctgaagattttgcagtgtattactgtcagcagbhcbhcagtbhctwcacttttggcggagggaccaag

SEQ ID NO: 921 - DNA, 69 bp, Artificial Sequence
  Description of Artificial Sequence: Synthetic oligonucleotide
cctgaagattttgcagtgtattactgtcagcagbhcbhcagtbhcmtcacttttggcggagggaccaag

SEQ ID NO: 922 - DNA, 69 bp, Artificial Sequence
  Description of Artificial Sequence: Synthetic oligonucleotide
cctgaagattttgcagtgtattactgtcagcagbhcbhcagtbhcwggacttttggcggagggaccaag

SEQ ID NO: 923 - DNA, 69 bp, Artificial Sequence
  Description of Artificial Sequence: Synthetic oligonucleotide
cctgaagattttgcagtgtattactgtcagcagbhcbhcagtbhccctacttttggcggagggaccaag

SEQ ID NO: 924 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhctwcacttttggcggagggaccaag

SEQ ID NO: 925 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhcmtcacttttggcggagggaccaag

SEQ ID NO: 926 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhcwggacttttggcggagggaccaag

SEQ ID NO: 927 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctacttttggcggagggaccaag

SEQ ID NO: 928 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhctwcacttttggcggagggaccaag

SEQ ID NO: 929 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhcmtcacttttggcggagggaccaag

SEQ ID NO: 930 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhcwggacttttggcggagggaccaag

SEQ ID NO: 931 - DNA, 69 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctacttttggcggagggaccaag

SEQ ID NO: 932 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcacttwcacttttggcggagggaccaag

SEQ ID NO: 933 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactmtcacttttggcggagggaccaag

SEQ ID NO: 934 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactwggacttttggcggagggaccaag

SEQ ID NO: 935 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctacttttggcggagggaccaag

SEQ ID NO: 936 - DNA, 69 bp, Artificial Sequence
  Description of Artificial Sequence: Synthetic oligonucleotide
gctgaagatgtggcagtttattactgtcagcagbhcbhcagtbhctwcacttttggcggagggaccaag

SEQ ID NO: 937 - DNA, 69 bp, Artificial Sequence
  Description of Artificial Sequence: Synthetic oligonucleotide
gctgaagatgtggcagtttattactgtcagcagbhcbhcagtbhcmtcacttttggcggagggaccaag

SEQ ID NO: 938 - DNA, 69 bp, Artificial Sequence
  Description of Artificial Sequence: Synthetic oligonucleotide
gctgaagatgtggcagtttattactgtcagcagbhcbhcagtbhcwggacttttggcggagggaccaag

SEQ ID NO: 939 - DNA, 69 bp, Artificial Sequence
  Description of Artificial Sequence: Synthetic oligonucleotide
gctgaagatgtggcagtttattactgtcagcagbhcbhcagtbhccctacttttggcggagggaccaag

SEQ ID NO: 940 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhctwcacttttggcggagggaccaag

SEQ ID NO: 941 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhcmtcacttttggcggagggaccaag

SEQ ID NO: 942 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhcwggacttttggcggagggaccaag

SEQ ID NO: 943 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctacttttggcggagggaccaag

SEQ ID NO: 944 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhctwcacttttggcggagggaccaag

SEQ ID NO: 945 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhcmtcacttttggcggagggaccaag

SEQ ID NO: 946 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhcwggacttttggcggagggaccaag

SEQ ID NO: 947 - DNA, 69 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctacttttggcggagggaccaag

SEQ ID NO: 948 - DNA, 24 bp, Artificial Sequence
  Description of Artificial Sequence: Synthetic oligonucleotide
swmswmtacaatagttactwcact

SEQ ID NO: 949 - DNA, 24 bp, Artificial Sequence
  Description of Artificial Sequence: Synthetic oligonucleotide
cagcagbhcvrmagttactwcact

SEQ ID NO: 950 - DNA, 24 bp, Artificial Sequence
  Description of Artificial Sequence: Synthetic oligonucleotide
cagcagbhcaatmbctactwcact

SEQ ID NO: 951 - DNA, 24 bp, Artificial Sequence
  Description of Artificial Sequence: Synthetic oligonucleotide
cagcagbhcaatagtywctwcact

SEQ ID NO: 952 - DNA, 24 bp, Artificial Sequence
  Description of Artificial Sequence: Synthetic oligonucleotide
cagcagtacvrmmbctactwcact

SEQ ID NO: 953 - DNA, 24 bp, Artificial Sequence
  Description of Artificial Sequence: Synthetic oligonucleotide
cagcagtacvrmagtywctwcact

SEQ ID NO: 954 - DNA, 24 bp, Artificial Sequence
  Description of Artificial Sequence: Synthetic oligonucleotide
cagcagtacaatmbcywctwcact

SEQ ID NO: 955 - DNA, 24 bp, Artificial Sequence
  Description of Artificial Sequence: Synthetic oligonucleotide
swmcagbhcaatagttactwcact

SEQ ID NO: 956 - DNA, 24 bp, Artificial Sequence
  Description of Artificial Sequence: Synthetic oligonucleotide
swmcagtacvrmagttactwcact

SEQ ID NO: 957 - DNA, 24 bp, Artificial Sequence
  Description of Artificial Sequence: Synthetic oligonucleotide
swmcagtacaatmbctactwcact

SEQ ID NO: 958 - DNA, 24 bp, Artificial Sequence
  Description of Artificial Sequence: Synthetic oligonucleotide
swmcagtacaatagtywctwcact

SEQ ID NO: 959 - DNA, 24 bp, Artificial Sequence
  Description of Artificial Sequence: Synthetic oligonucleotide
cagswmbhcaatagttactwcact

SEQ ID NO: 960 - DNA, 24 bp, Artificial Sequence
  Description of Artificial Sequence: Synthetic oligonucleotide
cagswmtacvrmagttactwcact

SEQ ID NO: 961 - DNA, 24 bp, Artificial Sequence
  Description of Artificial Sequence: Synthetic oligonucleotide
cagswmtacaatmbctactwcact

SEQ ID NO: 962 - DNA, 24 bp, Artificial Sequence
  Description of Artificial Sequence: Synthetic oligonucleotide
cagswmtacaatagtywctwcact

SEQ ID NO: 963 - DNA, 24 bp, Artificial Sequence
  Description of Artificial Sequence: Synthetic oligonucleotide
swmswmtacaatagttacmtcact

SEQ ID NO: 964 - DNA, 24 bp, Artificial Sequence
  Description of Artificial Sequence: Synthetic oligonucleotide
cagcagbhcvrmagttacmtcact

SEQ ID NO: 965 - DNA, 24 bp, Artificial Sequence
  Description of Artificial Sequence: Synthetic oligonucleotide
cagcagbhcaatmbctacmtcact

SEQ ID NO: 966 - DNA, 24 bp, Artificial Sequence
  Description of Artificial Sequence: Synthetic oligonucleotide
cagcagbhcaatagtywcmtcact

SEQ ID NO: 967 - DNA, 24 bp, Artificial Sequence
  Description of Artificial Sequence: Synthetic oligonucleotide
cagcagtacvrmmbctacmtcact

SEQ ID NO: 968 - DNA, 24 bp, Artificial Sequence
  Description of Artificial Sequence: Synthetic oligonucleotide
cagcagtacvrmagtywcmtcact

SEQ ID NO: 969 - DNA, 24 bp, Artificial Sequence
  Description of Artificial Sequence: Synthetic oligonucleotide
cagcagtacaatmbcywcmtcact

SEQ ID NO: 970 - DNA, 24 bp, Artificial Sequence
  Description of Artificial Sequence: Synthetic oligonucleotide
swmcagbhcaatagttacmtcact

SEQ ID NO: 971 - DNA, 24 bp, Artificial Sequence
  Description of Artificial Sequence: Synthetic oligonucleotide
swmcagtacvrmagttacmtcact

SEQ ID NO: 972 - DNA, 24 bp, Artificial Sequence
  Description of Artificial Sequence: Synthetic oligonucleotide
swmcagtacaatmbctacmtcact

SEQ ID NO: 973 - DNA, 24 bp, Artificial Sequence
  Description of Artificial Sequence: Synthetic oligonucleotide
swmcagtacaatagtywcmtcact

SEQ ID NO: 974 - DNA, 24 bp, Artificial Sequence
  Description of Artificial Sequence: Synthetic oligonucleotide
cagswmbhcaatagttacmtcact

SEQ ID NO: 975 - DNA, 24 bp, Artificial Sequence
  Description of Artificial Sequence: Synthetic oligonucleotide
cagswmtacvrmagttacmtcact

SEQ ID NO: 976 - DNA, 24 bp, Artificial Sequence
  Description of Artificial Sequence: Synthetic oligonucleotide
cagswmtacaatmbctacmtcact

SEQ ID NO: 977 - DNA, 24 bp, Artificial Sequence
  Description of Artificial Sequence: Synthetic oligonucleotide
cagswmtacaatagtywcmtcact

SEQ ID NO: 978 - DNA, 24 bp, Artificial Sequence
  Description of Artificial Sequence: Synthetic oligonucleotide
swmswmtacaatagttacwggact

SEQ ID NO: 979 - DNA, 24 bp, Artificial Sequence
  Description of Artificial Sequence: Synthetic oligonucleotide
cagcagbhcvrmagttacwggact

SEQ ID NO: 980 - DNA, 24 bp, Artificial Sequence
  Description of Artificial Sequence: Synthetic oligonucleotide
cagcagbhcaatmbctacwggact

SEQ ID NO: 981 - DNA, 24 bp, Artificial Sequence
  Description of Artificial Sequence: Synthetic oligonucleotide
cagcagbhcaatagtywcwggact

SEQ ID NO: 982 - DNA, 24 bp, Artificial Sequence
  Description of Artificial Sequence: Synthetic oligonucleotide
cagcagtacvrmmbctacwggact

SEQ ID NO: 983 - DNA, 24 bp, Artificial Sequence
  Description of Artificial Sequence: Synthetic oligonucleotide
cagcagtacvrmagtywcwggact

SEQ ID NO: 984 - DNA, 24 bp, Artificial Sequence
  Description of Artificial Sequence: Synthetic oligonucleotide
cagcagtacaatmbcywcwggact

SEQ ID NO: 985 - DNA, 24 bp, Artificial Sequence
  Description of Artificial Sequence: Synthetic oligonucleotide
swmcagbhcaatagttacwggact

SEQ ID NO: 986 - DNA, 24 bp, Artificial Sequence
  Description of Artificial Sequence: Synthetic oligonucleotide
swmcagtacvrmagttacwggact

SEQ ID NO: 987 - DNA, 24 bp, Artificial Sequence
  Description of Artificial Sequence: Synthetic oligonucleotide
swmcagtacaatmbctacwggact

SEQ ID NO: 988 - DNA, 24 bp, Artificial Sequence
  Description of Artificial Sequence: Synthetic oligonucleotide
swmcagtacaatagtywcwggact

SEQ ID NO: 989 - DNA, 24 bp, Artificial Sequence
  Description of Artificial Sequence: Synthetic oligonucleotide
cagswmbhcaatagttacwggact

SEQ ID NO: 990 - DNA, 24 bp, Artificial Sequence
  Description of Artificial Sequence: Synthetic oligonucleotide
cagswmtacvrmagttacwggact

SEQ ID NO: 991 - DNA, 24 bp, Artificial Sequence
  Description of Artificial Sequence: Synthetic oligonucleotide
cagswmtacaatmbctacwggact

SEQ ID NO: 992 - DNA, 24 bp, Artificial Sequence
  Description of Artificial Sequence: Synthetic oligonucleotide
cagswmtacaatagtywcwggact

SEQ ID NO: 993 - DNA, 24 bp, Artificial Sequence
  Description of Artificial Sequence: Synthetic oligonucleotide
swmswmtacaatagttaccctact

SEQ ID NO: 994 - DNA, 24 bp, Artificial Sequence
  Description of Artificial Sequence: Synthetic oligonucleotide
cagcagbhcvrmagttaccctact

SEQ ID NO: 995 - DNA, 24 bp, Artificial Sequence
  Description of Artificial Sequence: Synthetic oligonucleotide
cagcagbhcaatmbctaccctact

SEQ ID NO: 996 - DNA, 24 bp, Artificial Sequence
  Description of Artificial Sequence: Synthetic oligonucleotide
cagcagbhcaatagtywccctact

SEQ ID NO: 997 - DNA, 24 bp, Artificial Sequence
  Description of Artificial Sequence: Synthetic oligonucleotide
cagcagtacvrmmbctaccctact

SEQ ID NO: 998 - DNA, 24 bp, Artificial Sequence
  Description of Artificial Sequence: Synthetic oligonucleotide
cagcagtacvrmagtywccctact

SEQ ID NO: 999 - DNA, 24 bp, Artificial Sequence
  Description of Artificial Sequence: Synthetic oligonucleotide
cagcagtacaatmbcywccctact

SEQ ID NO: 1000 - DNA, 24 bp, Artificial Sequence
  Description of Artificial Sequence: Synthetic oligonucleotide
swmcagbhcaatagttaccctact

SEQ ID NO: 1001 - DNA, 24 bp, Artificial Sequence
  Description of Artificial Sequence: Synthetic oligonucleotide
swmcagtacvrmagttaccctact

SEQ ID NO: 1002 - DNA, 24 bp, Artificial Sequence
  Description of Artificial Sequence: Synthetic oligonucleotide
swmcagtacaatmbctaccctact

SEQ ID NO: 1003 - DNA, 24 bp, Artificial Sequence
  Description of Artificial Sequence: Synthetic oligonucleotide
swmcagtacaatagtywccctact

SEQ ID NO: 1004 - DNA, 24 bp, Artificial Sequence
  Description of Artificial Sequence: Synthetic oligonucleotide
cagswmbhcaatagttaccctact

SEQ ID NO: 1005 - DNA, 24 bp, Artificial Sequence
  Description of Artificial Sequence: Synthetic oligonucleotide
cagswmtacvrmagttaccctact

SEQ ID NO: 1006 - DNA, 24 bp, Artificial Sequence
  Description of Artificial Sequence: Synthetic oligonucleotide
cagswmtacaatmbctaccctact

SEQ ID NO: 1007 - DNA, 24 bp, Artificial Sequence
  Description of Artificial Sequence: Synthetic oligonucleotide
cagswmtacaatagtywccctact

SEQ ID NO: 1008 - DNA, 24 bp, Artificial Sequence
  Description of Artificial Sequence: Synthetic oligonucleotide
swmswmgcaaatagtttctwcact

SEQ ID NO: 1009 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttctwcact

SEQ ID NO: 1010 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttctwcact

SEQ ID NO: 1011 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywctwcact

SEQ ID NO: 1012 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttctwcact

SEQ ID NO: 1013 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywctwcact

SEQ ID NO: 1014 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywctwcact

SEQ ID NO: 1015 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttctwcact

SEQ ID NO: 1016 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttctwcact

SEQ ID NO: 1017 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttctwcact

SEQ ID NO: 1018 - DNA, 24 bp, Artificial Sequence
  Description of Artificial Sequence: Synthetic oligonucleotide
swmcaggcaaatagtywctwcact

SEQ ID NO: 1019 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttctwcact

SEQ ID NO: 1020 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttctwcact

SEQ ID NO: 1021 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttctwcact

SEQ ID NO: 1022 - DNA, 24 bp, Artificial Sequence
  Description of Artificial Sequence: Synthetic oligonucleotide
cagswmgcaaatagtywctwcact

SEQ ID NO: 1023 - DNA, 24 bp, Artificial Sequence
  Description of Artificial Sequence: Synthetic oligonucleotide
swmswmgcaaatagtttcmtcact

SEQ ID NO: 1024 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttcmtcact

SEQ ID NO: 1025 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttcmtcact

SEQ ID NO: 1026 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywcmtcact

SEQ ID NO: 1027 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttcmtcact

SEQ ID NO: 1028 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywcmtcact

SEQ ID NO: 1029 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywcmtcact

SEQ ID NO: 1030 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttcmtcact

SEQ ID NO: 1031 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttcmtcact

SEQ ID NO: 1032 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttcmtcact

SEQ ID NO: 1033 - DNA, 24 bp, Artificial Sequence
  Description of Artificial Sequence: Synthetic oligonucleotide
swmcaggcaaatagtywcmtcact

SEQ ID NO: 1034 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttcmtcact

SEQ ID NO: 1035 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttcmtcact

SEQ ID NO: 1036 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttcmtcact

SEQ ID NO: 1037 - DNA, 24 bp, Artificial Sequence
  Description of Artificial Sequence: Synthetic oligonucleotide
cagswmgcaaatagtywcmtcact

SEQ ID NO: 1038 - DNA, 24 bp, Artificial Sequence
  Description of Artificial Sequence: Synthetic oligonucleotide
swmswmgcaaatagtttcwggact

SEQ ID NO: 1039 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttcwggact

SEQ ID NO: 1040 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttcwggact

SEQ ID NO: 1041 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywcwggact

SEQ ID NO: 1042 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttcwggact

SEQ ID NO: 1043 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywcwggact

SEQ ID NO: 1044 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywcwggact

SEQ ID NO: 1045 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttcwggact

SEQ ID NO: 1046 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttcwggact

SEQ ID NO: 1047 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttcwggact

SEQ ID NO: 1048 - DNA, 24 bp, Artificial Sequence
  Description of Artificial Sequence: Synthetic oligonucleotide
swmcaggcaaatagtywcwggact

SEQ ID NO: 1049 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttcwggact

SEQ ID NO: 1050 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttcwggact

SEQ ID NO: 1051 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttcwggact

SEQ ID NO: 1052 - DNA, 24 bp, Artificial Sequence
  Description of Artificial Sequence: Synthetic oligonucleotide
cagswmgcaaatagtywcwggact

SEQ ID NO: 1053 - DNA, 24 bp, Artificial Sequence
  Description of Artificial Sequence: Synthetic oligonucleotide
swmswmgcaaatagtttccctact

SEQ ID NO: 1054 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctact

SEQ ID NO: 1055 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctact

SEQ ID NO: 1056 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctact

SEQ ID NO: 1057 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctact

SEQ ID NO: 1058 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctact

SEQ ID NO: 1059 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctact

SEQ ID NO: 1060 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctact

SEQ ID NO: 1061 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctact

SEQ ID NO: 1062 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctact

SEQ ID NO: 1063 - DNA, 24 bp, Artificial Sequence
  Description of Artificial Sequence: Synthetic oligonucleotide
swmcaggcaaatagtywccctact

SEQ ID NO: 1064 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctact

SEQ ID NO: 1065 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctact

SEQ ID NO: 1066 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctact

SEQ ID NO: 1067 - DNA, 24 bp, Artificial Sequence
  Description of Artificial Sequence: Synthetic oligonucleotide
cagswmgcaaatagtywccctact

SEQ ID NO: 1068 - DNA, 24 bp, Artificial Sequence
  Description of Artificial Sequence: Synthetic oligonucleotide
swmswmtacgataatctctwcact

SEQ ID NO: 1069 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctctwcact

SEQ ID NO: 1070 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctctwcact

SEQ ID NO: 1071 - DNA, 24 bp, Artificial Sequence
  Description of Artificial Sequence: Synthetic oligonucleotide
cagcagbhcgataatywctwcact

SEQ ID NO: 1072 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctctwcact

SEQ ID NO: 1073 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywctwcact

SEQ ID NO: 1074 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywctwcact

SEQ ID NO: 1075 - DNA, 24 bp, Artificial Sequence
  Description of Artificial Sequence: Synthetic oligonucleotide
swmcagbhcgataatctctwcact

SEQ ID NO: 1076 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctctwcact

SEQ ID NO: 1077 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctctwcact

SEQ ID NO: 1078 - DNA, 24 bp, Artificial Sequence
  Description of Artificial Sequence: Synthetic oligonucleotide
swmcagtacgataatywctwcact

SEQ ID NO: 1079 - DNA, 24 bp, Artificial Sequence
  Description of Artificial Sequence: Synthetic oligonucleotide
cagswmbhcgataatctctwcact

SEQ ID NO: 1080 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctctwcact

SEQ ID NO: 1081 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctctwcact

SEQ ID NO: 1082 - DNA, 24 bp, Artificial Sequence
  Description of Artificial Sequence: Synthetic oligonucleotide
cagswmtacgataatywctwcact

SEQ ID NO: 1083 - DNA, 24 bp, Artificial Sequence
  Description of Artificial Sequence: Synthetic oligonucleotide
swmswmtacgataatctcmtcact

SEQ ID NO: 1084 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctcmtcact

SEQ ID NO: 1085 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctcmtcact

SEQ ID NO: 1086 - DNA, 24 bp, Artificial Sequence
  Description of Artificial Sequence: Synthetic oligonucleotide
cagcagbhcgataatywcmtcact

SEQ ID NO: 1087 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctcmtcact

SEQ ID NO: 1088 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywcmtcact

SEQ ID NO: 1089 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywcmtcact

SEQ ID NO: 1090 - DNA, 24 bp, Artificial Sequence
  Description of Artificial Sequence: Synthetic oligonucleotide
swmcagbhcgataatctcmtcact

SEQ ID NO: 1091 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctcmtcact

SEQ ID NO: 1092 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctcmtcact

SEQ ID NO: 1093 - DNA, 24 bp, Artificial Sequence
  Description of Artificial Sequence: Synthetic oligonucleotide
swmcagtacgataatywcmtcact

SEQ ID NO: 1094 - DNA, 24 bp, Artificial Sequence
  Description of Artificial Sequence: Synthetic oligonucleotide
cagswmbhcgataatctcmtcact

SEQ ID NO: 1095 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctcmtcact

SEQ ID NO: 1096 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctcmtcact

SEQ ID NO: 1097 - DNA, 24 bp, Artificial Sequence
  Description of Artificial Sequence: Synthetic oligonucleotide
cagswmtacgataatywcmtcact

SEQ ID NO: 1098 - DNA, 24 bp, Artificial Sequence
  Description of Artificial Sequence: Synthetic oligonucleotide
swmswmtacgataatctcwggact

SEQ ID NO: 1099 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctcwggact

SEQ ID NO: 1100 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctcwggact

SEQ ID NO: 1101 - DNA, 24 bp, Artificial Sequence
  Description of Artificial Sequence: Synthetic oligonucleotide
cagcagbhcgataatywcwggact

SEQ ID NO: 1102 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctcwggact

SEQ ID NO: 1103 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywcwggact

SEQ ID NO: 1104 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywcwggact

SEQ ID NO: 1105 - DNA, 24 bp, Artificial Sequence
  Description of Artificial Sequence: Synthetic oligonucleotide
swmcagbhcgataatctcwggact

SEQ ID NO: 1106 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctcwggact

SEQ ID NO: 1107 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctcwggact

SEQ ID NO: 1108 - DNA, 24 bp, Artificial Sequence
  Description of Artificial Sequence: Synthetic oligonucleotide
swmcagtacgataatywcwggact

SEQ ID NO: 1109 - DNA, 24 bp, Artificial Sequence
  Description of Artificial Sequence: Synthetic oligonucleotide
cagswmbhcgataatctcwggact

SEQ ID NO: 1110 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctcwggact

SEQ ID NO: 1111 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctcwggact

SEQ ID NO: 1112 - DNA, 24 bp, Artificial Sequence
  Description of Artificial Sequence: Synthetic oligonucleotide
cagswmtacgataatywcwggact

SEQ ID NO: 1113 - DNA, 24 bp, Artificial Sequence
  Description of Artificial Sequence: Synthetic oligonucleotide
swmswmtacgataatctccctact

SEQ ID NO: 1114 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctact

SEQ ID NO: 1115 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctact

SEQ ID NO: 1116 - DNA, 24 bp, Artificial Sequence
  Description of Artificial Sequence: Synthetic oligonucleotide
cagcagbhcgataatywccctact

SEQ ID NO: 1117 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctact

SEQ ID NO: 1118 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctact

SEQ ID NO: 1119 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctact

SEQ ID NO: 1120 - DNA, 24 bp, Artificial Sequence
  Description of Artificial Sequence: Synthetic oligonucleotide
swmcagbhcgataatctccctact

SEQ ID NO: 1121 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctact

SEQ ID NO: 1122 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctact

SEQ ID NO: 1123 - DNA, 24 bp, Artificial Sequence
  Description of Artificial Sequence: Synthetic oligonucleotide
swmcagtacgataatywccctact

SEQ ID NO: 1124 - DNA, 24 bp, Artificial Sequence
  Description of Artificial Sequence: Synthetic oligonucleotide
cagswmbhcgataatctccctact

SEQ ID NO: 1125 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctact

SEQ ID NO: 1126 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctact

SEQ ID NO: 1127 - DNA, 24 bp, Artificial Sequence
  Description of Artificial Sequence: Synthetic oligonucleotide
cagswmtacgataatywccctact

SEQ ID NO: 1128 - DNA, 24 bp, Artificial Sequence
  Description of Artificial Sequence: Synthetic oligonucleotide
swmswmagctacagtacttwcact

SEQ ID NO: 1129 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtacttwcact

SEQ ID NO: 1130 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcacttwcact

SEQ ID NO: 1131 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhctwcact

SEQ ID NO: 1132 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcacttwcact

SEQ ID NO: 1133 - DNA, 24 bp, Artificial Sequence
  Description of Artificial Sequence: Synthetic oligonucleotide
cagcaaagcbhcagtbhctwcact

SEQ ID NO: 1134 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhctwcact

SEQ ID NO: 1135 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtacttwcact

SEQ ID NO: 1136 - DNA, 24 bp, Artificial Sequence
  Description of Artificial Sequence: Synthetic oligonucleotide
swmcaaagcbhcagtacttwcact

SEQ ID NO: 1137 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcacttwcact

SEQ ID NO: 1138 - DNA, 24 bp, Artificial Sequence
  Description of Artificial Sequence: Synthetic oligonucleotide
swmcaaagctacagtbhctwcact

SEQ ID NO: 1139 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtacttwcact

SEQ ID NO: 1140 - DNA, 24 bp, Artificial Sequence
  Description of Artificial Sequence: Synthetic oligonucleotide
cagswmagcbhcagtacttwcact

SEQ ID NO: 1141 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcacttwcact

SEQ ID NO: 1142 - DNA, 24 bp, Artificial Sequence
  Description of Artificial Sequence: Synthetic oligonucleotide
cagswmagctacagtbhctwcact

SEQ ID NO: 1143 - DNA, 24 bp, Artificial Sequence
  Description of Artificial Sequence: Synthetic oligonucleotide
swmswmagctacagtactmtcact

SEQ ID NO: 1144 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactmtcact

SEQ ID NO: 1145 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactmtcact

SEQ ID NO: 1146 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhcmtcact

SEQ ID NO: 1147 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactmtcact

SEQ ID NO: 1148 - DNA, 24 bp, Artificial Sequence
  Description of Artificial Sequence: Synthetic oligonucleotide
cagcaaagcbhcagtbhcmtcact

SEQ ID NO: 1149 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhcmtcact

SEQ ID NO: 1150 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactmtcact

SEQ ID NO: 1151 - DNA, 24 bp, Artificial Sequence
  Description of Artificial Sequence: Synthetic oligonucleotide
swmcaaagcbhcagtactmtcact

SEQ ID NO: 1152 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactmtcact

SEQ ID NO: 1153 - DNA, 24 bp, Artificial Sequence
  Description of Artificial Sequence: Synthetic oligonucleotide
swmcaaagctacagtbhcmtcact

SEQ ID NO: 1154 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactmtcact

SEQ ID NO: 1155 - DNA, 24 bp, Artificial Sequence
  Description of Artificial Sequence: Synthetic oligonucleotide
cagswmagcbhcagtactmtcact

SEQ ID NO: 1156 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactmtcact

SEQ ID NO: 1157 - DNA, 24 bp, Artificial Sequence
  Description of Artificial Sequence: Synthetic oligonucleotide
cagswmagctacagtbhcmtcact

SEQ ID NO: 1158 - DNA, 24 bp, Artificial Sequence
  Description of Artificial Sequence: Synthetic oligonucleotide
swmswmagctacagtactwggact

SEQ ID NO: 1159 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactwggact

SEQ ID NO: 1160 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactwggact

SEQ ID NO: 1161 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhcwggact

SEQ ID NO: 1162 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactwggact

SEQ ID NO: 1163 - DNA, 24 bp, Artificial Sequence
  Description of Artificial Sequence: Synthetic oligonucleotide
cagcaaagcbhcagtbhcwggact

SEQ ID NO: 1164 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhcwggact

SEQ ID NO: 1165 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactwggact

SEQ ID NO: 1166 - DNA, 24 bp, Artificial Sequence
  Description of Artificial Sequence: Synthetic oligonucleotide
swmcaaagcbhcagtactwggact

SEQ ID NO: 1167 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactwggact

SEQ ID NO: 1168 - DNA, 24 bp, Artificial Sequence
  Description of Artificial Sequence: Synthetic oligonucleotide
swmcaaagctacagtbhcwggact

SEQ ID NO: 1169 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactwggact

SEQ ID NO: 1170 - DNA, 24 bp, Artificial Sequence
  Description of Artificial Sequence: Synthetic oligonucleotide
cagswmagcbhcagtactwggact

SEQ ID NO: 1171 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactwggact

SEQ ID NO: 1172 - DNA, 24 bp, Artificial Sequence
  Description of Artificial Sequence: Synthetic oligonucleotide
cagswmagctacagtbhcwggact

SEQ ID NO: 1173 - DNA, 24 bp, Artificial Sequence
  Description of Artificial Sequence: Synthetic oligonucleotide
swmswmagctacagtactcctact

SEQ ID NO: 1174 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctact

SEQ ID NO: 1175 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctact

SEQ ID NO: 1176 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctact

SEQ ID NO: 1177 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctact

SEQ ID NO: 1178 - DNA, 24 bp, Artificial Sequence
  Description of Artificial Sequence: Synthetic oligonucleotide
cagcaaagcbhcagtbhccctact

SEQ ID NO: 1179 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctact

SEQ ID NO: 1180 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctact

SEQ ID NO: 1181 - DNA, 24 bp, Artificial Sequence
  Description of Artificial Sequence: Synthetic oligonucleotide
swmcaaagcbhcagtactcctact

SEQ ID NO: 1182 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctact

SEQ ID NO: 1183 - DNA, 24 bp, Artificial Sequence
  Description of Artificial Sequence: Synthetic oligonucleotide
swmcaaagctacagtbhccctact

SEQ ID NO: 1184 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctact

SEQ ID NO: 1185 - DNA, 24 bp, Artificial Sequence
  Description of Artificial Sequence: Synthetic oligonucleotide
cagswmagcbhcagtactcctact

SEQ ID NO: 1186 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctact

SEQ ID NO: 1187 - DNA, 24 bp, Artificial Sequence
  Description of Artificial Sequence: Synthetic oligonucleotide
cagswmagctacagtbhccctact

SEQ ID NO: 1188 - DNA, 24 bp, Artificial Sequence
  Description of Artificial Sequence: Synthetic oligonucleotide
dtsswmgcactccagacttwcact

SEQ ID NO: 1189 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagacttwcact

SEQ ID NO: 1190 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmacttwcact

SEQ ID NO: 1191 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbctwcact

SEQ ID NO: 1192 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmacttwcact

SEQ ID NO: 1193 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbctwcact

SEQ ID NO: 1194 - DNA, 24 bp, Artificial Sequence
  Description of Artificial Sequence: Synthetic oligonucleotide
atgcaggcactcsrmvbctwcact

SEQ ID NO: 1195 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagacttwcact

SEQ ID NO: 1196 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagacttwcact

SEQ ID NO: 1197 - DNA, 24 bp, Artificial Sequence
  Description of Artificial Sequence: Synthetic oligonucleotide
dtscaggcactcsrmacttwcact

SEQ ID NO: 1198 - DNA, 24 bp, Artificial Sequence
  Description of Artificial Sequence: Synthetic oligonucleotide
dtscaggcactccagvbctwcact

SEQ ID NO: 1199 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagacttwcact

SEQ ID NO: 1200 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagacttwcact

SEQ ID NO: 1201 - DNA, 24 bp, Artificial Sequence
  Description of Artificial Sequence: Synthetic oligonucleotide
atgswmgcactcsrmacttwcact

SEQ ID NO: 1202 - DNA, 24 bp, Artificial Sequence
  Description of Artificial Sequence: Synthetic oligonucleotide
atgswmgcactccagvbctwcact

SEQ ID NO: 1203 - DNA, 24 bp, Artificial Sequence
  Description of Artificial Sequence: Synthetic oligonucleotide
dtsswmgcactccagactmtcact

SEQ ID NO: 1204 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactmtcact

SEQ ID NO: 1205 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactmtcact

SEQ ID NO: 1206 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbcmtcact

SEQ ID NO: 1207 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactmtcact

SEQ ID NO: 1208 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbcmtcact

SEQ ID NO: 1209 - DNA, 24 bp, Artificial Sequence
  Description of Artificial Sequence: Synthetic oligonucleotide
atgcaggcactcsrmvbcmtcact

SEQ ID NO: 1210 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactmtcact

SEQ ID NO: 1211 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactmtcact

SEQ ID NO: 1212 - DNA, 24 bp, Artificial Sequence
  Description of Artificial Sequence: Synthetic oligonucleotide
dtscaggcactcsrmactmtcact

SEQ ID NO: 1213 - DNA, 24 bp, Artificial Sequence
  Description of Artificial Sequence: Synthetic oligonucleotide
dtscaggcactccagvbcmtcact

SEQ ID NO: 1214 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactmtcact

SEQ ID NO: 1215 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactmtcact

SEQ ID NO: 1216 - DNA, 24 bp, Artificial Sequence
  Description of Artificial Sequence: Synthetic oligonucleotide
atgswmgcactcsrmactmtcact

SEQ ID NO: 1217 - DNA, 24 bp, Artificial Sequence
  Description of Artificial Sequence: Synthetic oligonucleotide
atgswmgcactccagvbcmtcact

SEQ ID NO: 1218 - DNA, 24 bp, Artificial Sequence
  Description of Artificial Sequence: Synthetic oligonucleotide
dtsswmgcactccagactwggact

SEQ ID NO: 1219 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactwggact

SEQ ID NO: 1220 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactwggact

SEQ ID NO: 1221 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbcwggact

SEQ ID NO: 1222 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactwggact

SEQ ID NO: 1223 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbcwggact

SEQ ID NO: 1224 - DNA, 24 bp, Artificial Sequence
  Description of Artificial Sequence: Synthetic oligonucleotide
atgcaggcactcsrmvbcwggact

SEQ ID NO: 1225 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactwggact

SEQ ID NO: 1226 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactwggact

SEQ ID NO: 1227 - DNA, 24 bp, Artificial Sequence
  Description of Artificial Sequence: Synthetic oligonucleotide
dtscaggcactcsrmactwggact

SEQ ID NO: 1228 - DNA, 24 bp, Artificial Sequence
  Description of Artificial Sequence: Synthetic oligonucleotide
dtscaggcactccagvbcwggact

SEQ ID NO: 1229 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactwggact

SEQ ID NO: 1230 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactwggact

SEQ ID NO: 1231 - DNA, 24 bp, Artificial Sequence
  Description of Artificial Sequence: Synthetic oligonucleotide
atgswmgcactcsrmactwggact

SEQ ID NO: 1232 - DNA, 24 bp, Artificial Sequence
  Description of Artificial Sequence: Synthetic oligonucleotide
atgswmgcactccagvbcwggact

SEQ ID NO: 1233 - DNA, 24 bp, Artificial Sequence
  Description of Artificial Sequence: Synthetic oligonucleotide
dtsswmgcactccagactcctact

SEQ ID NO: 1234 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctact

SEQ ID NO: 1235 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctact

SEQ ID NO: 1236 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctact

SEQ ID NO: 1237 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctact

SEQ ID NO: 1238 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctact

SEQ ID NO: 1239 - DNA, 24 bp, Artificial Sequence
  Description of Artificial Sequence: Synthetic oligonucleotide
atgcaggcactcsrmvbccctact

SEQ ID NO: 1240 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctact

SEQ ID NO: 1241 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctact

SEQ ID NO: 1242 - DNA, 24 bp, Artificial Sequence
  Description of Artificial Sequence: Synthetic oligonucleotide
dtscaggcactcsrmactcctact

SEQ ID NO: 1243 - DNA, 24 bp, Artificial Sequence
  Description of Artificial Sequence: Synthetic oligonucleotide
dtscaggcactccagvbccctact

SEQ ID NO: 1244 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctact

SEQ ID NO: 1245 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctact

SEQ ID NO: 1246 - DNA, 24 bp, Artificial Sequence
  Description of Artificial Sequence: Synthetic oligonucleotide
atgswmgcactcsrmactcctact

SEQ ID NO: 1247 - DNA, 24 bp, Artificial Sequence
  Description of Artificial Sequence: Synthetic oligonucleotide
atgswmgcactccagvbccctact

SEQ ID NO: 1248 - DNA, 24 bp, Artificial Sequence
  Description of Artificial Sequence: Synthetic oligonucleotide
swmswmagaagtaattggtwcact

SEQ ID NO: 1249 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggtwcact

SEQ ID NO: 1250 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggtwcact

SEQ ID NO: 1251 - DNA, 24 bp, Artificial Sequence
  Description of Artificial Sequence: Synthetic oligonucleotide
cagcagbhcagtaatywctwcact

SEQ ID NO: 1252 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggtwcact

SEQ ID NO: 1253 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywctwcact

SEQ ID NO: 1254 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywctwcact

SEQ ID NO: 1255 - DNA, 24 bp, Artificial Sequence
  Description of Artificial Sequence: Synthetic oligonucleotide
swmcagbhcagtaattggtwcact

SEQ ID NO: 1256 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggtwcact

SEQ ID NO: 1257 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggtwcact

SEQ ID NO: 1258 - DNA, 24 bp, Artificial Sequence
  Description of Artificial Sequence: Synthetic oligonucleotide
swmcagagaagtaatywctwcact

SEQ ID NO: 1259 - DNA, 24 bp, Artificial Sequence
  Description of Artificial Sequence: Synthetic oligonucleotide
cagswmbhcagtaattggtwcact

SEQ ID NO: 1260 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggtwcact

SEQ ID NO: 1261 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggtwcact

SEQ ID NO: 1262 - DNA, 24 bp, Artificial Sequence
  Description of Artificial Sequence: Synthetic oligonucleotide
cagswmagaagtaatywctwcact

SEQ ID NO: 1263 - DNA, 24 bp, Artificial Sequence
  Description of Artificial Sequence: Synthetic oligonucleotide
swmswmagaagtaattggmtcact

SEQ ID NO: 1264 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggmtcact

SEQ ID NO: 1265 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggmtcact

SEQ ID NO: 1266 - DNA, 24 bp, Artificial Sequence
  Description of Artificial Sequence: Synthetic oligonucleotide
cagcagbhcagtaatywcmtcact

SEQ ID NO: 1267 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggmtcact

SEQ ID NO: 1268 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywcmtcact

SEQ ID NO: 1269 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywcmtcact

SEQ ID NO: 1270 - DNA, 24 bp, Artificial Sequence
  Description of Artificial Sequence: Synthetic oligonucleotide
swmcagbhcagtaattggmtcact

SEQ ID NO: 1271 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggmtcact

SEQ ID NO: 1272 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggmtcact

SEQ ID NO: 1273 - DNA, 24 bp, Artificial Sequence
  Description of Artificial Sequence: Synthetic oligonucleotide
swmcagagaagtaatywcmtcact

SEQ ID NO: 1274 - DNA, 24 bp, Artificial Sequence
  Description of Artificial Sequence: Synthetic oligonucleotide
cagswmbhcagtaattggmtcact

SEQ ID NO: 1275 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggmtcact

SEQ ID NO: 1276 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggmtcact

SEQ ID NO: 1277 - DNA, 24 bp, Artificial Sequence
  Description of Artificial Sequence: Synthetic oligonucleotide
cagswmagaagtaatywcmtcact

SEQ ID NO: 1278 - DNA, 24 bp, Artificial Sequence
  Description of Artificial Sequence: Synthetic oligonucleotide
swmswmagaagtaattggwggact

SEQ ID NO: 1279 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggwggact

SEQ ID NO: 1280 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggwggact

SEQ ID NO: 1281 - DNA, 24 bp, Artificial Sequence
  Description of Artificial Sequence: Synthetic oligonucleotide
cagcagbhcagtaatywcwggact

SEQ ID NO: 1282 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggwggact

SEQ ID NO: 1283 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywcwggact

SEQ ID NO: 1284 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywcwggact

SEQ ID NO: 1285 - DNA, 24 bp, Artificial Sequence
  Description of Artificial Sequence: Synthetic oligonucleotide
swmcagbhcagtaattggwggact

SEQ ID NO: 1286 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggwggact

SEQ ID NO: 1287 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggwggact

SEQ ID NO: 1288 - DNA, 24 bp, Artificial Sequence
  Description of Artificial Sequence: Synthetic oligonucleotide
swmcagagaagtaatywcwggact

SEQ ID NO: 1289 - DNA, 24 bp, Artificial Sequence
  Description of Artificial Sequence: Synthetic oligonucleotide
cagswmbhcagtaattggwggact

SEQ ID NO: 1290 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggwggact

SEQ ID NO: 1291 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggwggact

SEQ ID NO: 1292 - DNA, 24 bp, Artificial Sequence
  Description of Artificial Sequence: Synthetic oligonucleotide
cagswmagaagtaatywcwggact

SEQ ID NO: 1293 - DNA, 24 bp, Artificial Sequence
  Description of Artificial Sequence: Synthetic oligonucleotide
swmswmagaagtaattggcctact

SEQ ID NO: 1294 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctact

SEQ ID NO: 1295 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctact

SEQ ID NO: 1296 - DNA, 24 bp, Artificial Sequence
  Description of Artificial Sequence: Synthetic oligonucleotide
cagcagbhcagtaatywccctact

SEQ ID NO: 1297 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctact

SEQ ID NO: 1298 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctact

SEQ ID NO: 1299 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctact

SEQ ID NO: 1300 - DNA, 24 bp, Artificial Sequence
  Description of Artificial Sequence: Synthetic oligonucleotide
swmcagbhcagtaattggcctact

SEQ ID NO: 1301 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctact

SEQ ID NO: 1302 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctact

SEQ ID NO: 1303 - DNA, 24 bp, Artificial Sequence
  Description of Artificial Sequence: Synthetic oligonucleotide
swmcagagaagtaatywccctact

SEQ ID NO: 1304 - DNA, 24 bp, Artificial Sequence
  Description of Artificial Sequence: Synthetic oligonucleotide
cagswmbhcagtaattggcctact

SEQ ID NO: 1305 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctact

SEQ ID NO: 1306 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctact

SEQ ID NO: 1307 - DNA, 24 bp, Artificial Sequence
  Description of Artificial Sequence: Synthetic oligonucleotide
cagswmagaagtaatywccctact

SEQ ID NO: 1308 - DNA, 24 bp, Artificial Sequence
  Description of Artificial Sequence: Synthetic oligonucleotide
swmswmtacaataattggtwcact

SEQ ID NO: 1309 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggtwcact

SEQ ID NO: 1310 - DNA, 24 bp, Artificial Sequence
  Description of Artificial Sequence: Synthetic oligonucleotide
cagcagbhcaataatywctwcact

SEQ ID NO: 1311 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggtwcact

SEQ ID NO: 1312 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywctwcact

SEQ ID NO: 1313 - DNA, 24 bp, Artificial Sequence
  Description of Artificial Sequence: Synthetic oligonucleotide
swmcagbhcaataattggtwcact

SEQ ID NO: 1314 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggtwcact

SEQ ID NO: 1315 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggtwcact

SEQ ID NO: 1316 - DNA, 24 bp, Artificial Sequence
  Description of Artificial Sequence: Synthetic oligonucleotide
swmcagtacaataatywctwcact

SEQ ID NO: 1317 - DNA, 24 bp, Artificial Sequence
  Description of Artificial Sequence: Synthetic oligonucleotide
cagswmbhcaataattggtwcact

SEQ ID NO: 1318 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggtwcact

SEQ ID NO: 1319 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggtwcact

SEQ ID NO: 1320 - DNA, 24 bp, Artificial Sequence
  Description of Artificial Sequence: Synthetic oligonucleotide
cagswmtacaataatywctwcact

SEQ ID NO: 1321 - DNA, 24 bp, Artificial Sequence
  Description of Artificial Sequence: Synthetic oligonucleotide
swmswmtacaataattggmtcact

SEQ ID NO: 1322 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggmtcact

SEQ ID NO: 1323 - DNA, 24 bp, Artificial Sequence
  Description of Artificial Sequence: Synthetic oligonucleotide
cagcagbhcaataatywcmtcact

SEQ ID NO: 1324 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggmtcact

SEQ ID NO: 1325 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywcmtcact

SEQ ID NO: 1326 - DNA, 24 bp, Artificial Sequence
  Description of Artificial Sequence: Synthetic oligonucleotide
swmcagbhcaataattggmtcact

SEQ ID NO: 1327 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggmtcact

SEQ ID NO: 1328 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggmtcact

SEQ ID NO: 1329 - DNA, 24 bp, Artificial Sequence
  Description of Artificial Sequence: Synthetic oligonucleotide
swmcagtacaataatywcmtcact

SEQ ID NO: 1330 - DNA, 24 bp, Artificial Sequence
  Description of Artificial Sequence: Synthetic oligonucleotide
cagswmbhcaataattggmtcact

SEQ ID NO: 1331 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggmtcact

SEQ ID NO: 1332 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggmtcact

SEQ ID NO: 1333 - DNA, 24 bp, Artificial Sequence
  Description of Artificial Sequence: Synthetic oligonucleotide
cagswmtacaataatywcmtcact

SEQ ID NO: 1334 - DNA, 24 bp, Artificial Sequence
  Description of Artificial Sequence: Synthetic oligonucleotide
swmswmtacaataattggwggact

SEQ ID NO: 1335 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggwggact

SEQ ID NO: 1336 - DNA, 24 bp, Artificial Sequence
  Description of Artificial Sequence: Synthetic oligonucleotide
cagcagbhcaataatywcwggact

SEQ ID NO: 1337 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggwggact

SEQ ID NO: 1338 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywcwggact

SEQ ID NO: 1339 - DNA, 24 bp, Artificial Sequence
  Description of Artificial Sequence: Synthetic oligonucleotide
swmcagbhcaataattggwggact

SEQ ID NO: 1340 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggwggact

SEQ ID NO: 1341 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggwggact

SEQ ID NO: 1342 - DNA, 24 bp, Artificial Sequence
  Description of Artificial Sequence: Synthetic oligonucleotide
swmcagtacaataatywcwggact

SEQ ID NO: 1343 - DNA, 24 bp, Artificial Sequence
  Description of Artificial Sequence: Synthetic oligonucleotide
cagswmbhcaataattggwggact

SEQ ID NO: 1344 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggwggact

SEQ ID NO: 1345 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggwggact

SEQ ID NO: 1346 - DNA, 24 bp, Artificial Sequence
  Description of Artificial Sequence: Synthetic oligonucleotide
cagswmtacaataatywcwggact

SEQ ID NO: 1347 - DNA, 24 bp, Artificial Sequence
  Description of Artificial Sequence: Synthetic oligonucleotide
swmswmtacaataattggcctact

SEQ ID NO: 1348 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctact

SEQ ID NO: 1349 - DNA, 24 bp, Artificial Sequence
  Description of Artificial Sequence: Synthetic oligonucleotide
cagcagbhcaataatywccctact

SEQ ID NO: 1350 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctact

SEQ ID NO: 1351 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctact

SEQ ID NO: 1352 - DNA, 24 bp, Artificial Sequence
  Description of Artificial Sequence: Synthetic oligonucleotide
swmcagbhcaataattggcctact

SEQ ID NO: 1353 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctact

SEQ ID NO: 1354 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctact

SEQ ID NO: 1355 - DNA, 24 bp, Artificial Sequence
  Description of Artificial Sequence: Synthetic oligonucleotide
swmcagtacaataatywccctact

SEQ ID NO: 1356 - DNA, 24 bp, Artificial Sequence
  Description of Artificial Sequence: Synthetic oligonucleotide
cagswmbhcaataattggcctact

SEQ ID NO: 1357 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctact

SEQ ID NO: 1358 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctact

SEQ ID NO: 1359 - DNA, 24 bp, Artificial Sequence
  Description of Artificial Sequence: Synthetic oligonucleotide
cagswmtacaataatywccctact

SEQ ID NO: 1360 - DNA, 24 bp, Artificial Sequence
  Description of Artificial Sequence: Synthetic oligonucleotide
swmswmtacggaagtagttwcact

SEQ ID NO: 1361 - DNA, 24 bp, Artificial Sequence
  Description of Artificial Sequence: Synthetic oligonucleotide
cagcagbhcbhcagtagttwcact

SEQ ID NO: 1362 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagttwcact

SEQ ID NO: 1363 - DNA, 24 bp, Artificial Sequence
  Description of Artificial Sequence: Synthetic oligonucleotide
cagcagbhcggaagtbhctwcact

SEQ ID NO: 1364 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagttwcact

SEQ ID NO: 1365 - DNA, 24 bp, Artificial Sequence
  Description of Artificial Sequence: Synthetic oligonucleotide
cagcagtacbhcagtbhctwcact

SEQ ID NO: 1366 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhctwcact

SEQ ID NO: 1367 - DNA, 24 bp, Artificial Sequence
  Description of Artificial Sequence: Synthetic oligonucleotide
swmcagbhcggaagtagttwcact

SEQ ID NO: 1368 - DNA, 24 bp, Artificial Sequence
  Description of Artificial Sequence: Synthetic oligonucleotide
swmcagtacbhcagtagttwcact

SEQ ID NO: 1369 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagttwcact

SEQ ID NO: 1370 - DNA, 24 bp, Artificial Sequence
  Description of Artificial Sequence: Synthetic oligonucleotide
swmcagtacggaagtbhctwcact

SEQ ID NO: 1371 - DNA, 24 bp, Artificial Sequence
  Description of Artificial Sequence: Synthetic oligonucleotide
cagswmbhcggaagtagttwcact

SEQ ID NO: 1372 - DNA, 24 bp, Artificial Sequence
  Description of Artificial Sequence: Synthetic oligonucleotide
cagswmtacbhcagtagttwcact

SEQ ID NO: 1373 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagttwcact

SEQ ID NO: 1374 - DNA, 24 bp, Artificial Sequence
  Description of Artificial Sequence: Synthetic oligonucleotide
cagswmtacggaagtbhctwcact

SEQ ID NO: 1375 - DNA, 24 bp, Artificial Sequence
  Description of Artificial Sequence: Synthetic oligonucleotide
swmswmtacggaagtagtmtcact

SEQ ID NO: 1376 - DNA, 24 bp, Artificial Sequence
  Description of Artificial Sequence: Synthetic oligonucleotide
cagcagbhcbhcagtagtmtcact

SEQ ID NO: 1377 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtmtcact

SEQ ID NO: 1378 - DNA, 24 bp, Artificial Sequence
  Description of Artificial Sequence: Synthetic oligonucleotide
cagcagbhcggaagtbhcmtcact

SEQ ID NO: 1379 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtmtcact

SEQ ID NO: 1380 - DNA, 24 bp, Artificial Sequence
  Description of Artificial Sequence: Synthetic oligonucleotide
cagcagtacbhcagtbhcmtcact

SEQ ID NO: 1381 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhcmtcact

SEQ ID NO: 1382 - DNA, 24 bp, Artificial Sequence
  Description of Artificial Sequence: Synthetic oligonucleotide
swmcagbhcggaagtagtmtcact

SEQ ID NO: 1383 - DNA, 24 bp, Artificial Sequence
  Description of Artificial Sequence: Synthetic oligonucleotide
swmcagtacbhcagtagtmtcact

SEQ ID NO: 1384 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtmtcact

SEQ ID NO: 1385 - DNA, 24 bp, Artificial Sequence
  Description of Artificial Sequence: Synthetic oligonucleotide
swmcagtacggaagtbhcmtcact

SEQ ID NO: 1386 - DNA, 24 bp, Artificial Sequence
  Description of Artificial Sequence: Synthetic oligonucleotide
cagswmbhcggaagtagtmtcact

SEQ ID NO: 1387 - DNA, 24 bp, Artificial Sequence
  Description of Artificial Sequence: Synthetic oligonucleotide
cagswmtacbhcagtagtmtcact

SEQ ID NO: 1388 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtmtcact

SEQ ID NO: 1389 - DNA, 24 bp, Artificial Sequence
  Description of Artificial Sequence: Synthetic oligonucleotide
cagswmtacggaagtbhcmtcact

SEQ ID NO: 1390 - DNA, 24 bp, Artificial Sequence
  Description of Artificial Sequence: Synthetic oligonucleotide
swmswmtacggaagtagtwggact

SEQ ID NO: 1391 - DNA, 24 bp, Artificial Sequence
  Description of Artificial Sequence: Synthetic oligonucleotide
cagcagbhcbhcagtagtwggact

SEQ ID NO: 1392 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtwggact

SEQ ID NO: 1393 - DNA, 24 bp, Artificial Sequence
  Description of Artificial Sequence: Synthetic oligonucleotide
cagcagbhcggaagtbhcwggact

SEQ ID NO: 1394 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtwggact

SEQ ID NO: 1395 - DNA, 24 bp, Artificial Sequence
  Description of Artificial Sequence: Synthetic oligonucleotide
cagcagtacbhcagtbhcwggact

SEQ ID NO: 1396 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhcwggact

SEQ ID NO: 1397 - DNA, 24 bp, Artificial Sequence
  Description of Artificial Sequence: Synthetic oligonucleotide
swmcagbhcggaagtagtwggact

SEQ ID NO: 1398 - DNA, 24 bp, Artificial Sequence
  Description of Artificial Sequence: Synthetic oligonucleotide
swmcagtacbhcagtagtwggact

SEQ ID NO: 1399 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtwggact

SEQ ID NO: 1400 - DNA, 24 bp, Artificial Sequence
  Description of Artificial Sequence: Synthetic oligonucleotide
swmcagtacggaagtbhcwggact

SEQ ID NO: 1401 - DNA, 24 bp, Artificial Sequence
  Description of Artificial Sequence: Synthetic oligonucleotide
cagswmbhcggaagtagtwggact

SEQ ID NO: 1402 - DNA, 24 bp, Artificial Sequence
  Description of Artificial Sequence: Synthetic oligonucleotide
cagswmtacbhcagtagtwggact

SEQ ID NO: 1403 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtwggact

SEQ ID NO: 1404 - DNA, 24 bp, Artificial Sequence
  Description of Artificial Sequence: Synthetic oligonucleotide
cagswmtacggaagtbhcwggact

SEQ ID NO: 1405 - DNA, 24 bp, Artificial Sequence
  Description of Artificial Sequence: Synthetic oligonucleotide
swmswmtacggaagtagtcctact

SEQ ID NO: 1406 - DNA, 24 bp, Artificial Sequence
  Description of Artificial Sequence: Synthetic oligonucleotide
cagcagbhcbhcagtagtcctact

SEQ ID NO: 1407 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctact

SEQ ID NO: 1408 - DNA, 24 bp, Artificial Sequence
  Description of Artificial Sequence: Synthetic oligonucleotide
cagcagbhcggaagtbhccctact

SEQ ID NO: 1409 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctact

SEQ ID NO: 1410 - DNA, 24 bp, Artificial Sequence
  Description of Artificial Sequence: Synthetic oligonucleotide
cagcagtacbhcagtbhccctact

SEQ ID NO: 1411 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctact

SEQ ID NO: 1412 - DNA, 24 bp, Artificial Sequence
  Description of Artificial Sequence: Synthetic oligonucleotide
swmcagbhcggaagtagtcctact

SEQ ID NO: 1413 - DNA, 24 bp, Artificial Sequence
  Description of Artificial Sequence: Synthetic oligonucleotide
swmcagtacbhcagtagtcctact

SEQ ID NO: 1414 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctact

SEQ ID NO: 1415 - DNA, 24 bp, Artificial Sequence
  Description of Artificial Sequence: Synthetic oligonucleotide
swmcagtacggaagtbhccctact

SEQ ID NO: 1416 - DNA, 24 bp, Artificial Sequence
  Description of Artificial Sequence: Synthetic oligonucleotide
cagswmbhcggaagtagtcctact

SEQ ID NO: 1417 - DNA, 24 bp, Artificial Sequence
  Description of Artificial Sequence: Synthetic oligonucleotide
cagswmtacbhcagtagtcctact

SEQ ID NO: 1418 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctact

SEQ ID NO: 1419 - DNA, 24 bp, Artificial Sequence
  Description of Artificial Sequence: Synthetic oligonucleotide
cagswmtacggaagtbhccctact

SEQ ID NO: 1420 - DNA, 24 bp, Artificial Sequence
  Description of Artificial Sequence: Synthetic oligonucleotide
cagcagbhcvrmmbctactwcact

SEQ ID NO: 1421 - DNA, 24 bp, Artificial Sequence
  Description of Artificial Sequence: Synthetic oligonucleotide
cagcagbhcvrmmbctacmtcact

SEQ ID NO: 1422 - DNA, 24 bp, Artificial Sequence
  Description of Artificial Sequence: Synthetic oligonucleotide
cagcagbhcvrmmbctacwggact

SEQ ID NO: 1423 - DNA, 24 bp, Artificial Sequence
  Description of Artificial Sequence: Synthetic oligonucleotide
cagcagbhcvrmmbctacyctact

SEQ ID NO: 1424 - DNA, 24 bp, Artificial Sequence
  Description of Artificial Sequence: Synthetic oligonucleotide
cagcagbhcaatmbcywctwcact

SEQ ID NO: 1425 - DNA, 24 bp, Artificial Sequence
  Description of Artificial Sequence: Synthetic oligonucleotide
cagcagbhcaatmbcywcmtcact

SEQ ID NO: 1426 - DNA, 24 bp, Artificial Sequence
  Description of Artificial Sequence: Synthetic oligonucleotide
cagcagbhcaatmbcywcwggact

SEQ ID NO: 1427 - DNA, 24 bp, Artificial Sequence
  Description of Artificial Sequence: Synthetic oligonucleotide
cagcagbhcaatmbcywcyctact

SEQ ID NO: 1428 - DNA, 24 bp, Artificial Sequence
  Description of Artificial Sequence: Synthetic oligonucleotide
cagcagbhcvrmagtywctwcact

SEQ ID NO: 1429 - DNA, 24 bp, Artificial Sequence
  Description of Artificial Sequence: Synthetic oligonucleotide
cagcagbhcvrmagtywcmtcact

SEQ ID NO: 1430 - DNA, 24 bp, Artificial Sequence
  Description of Artificial Sequence: Synthetic oligonucleotide
cagcagbhcvrmagtywcwggact

SEQ ID NO: 1431 - DNA, 24 bp, Artificial Sequence
  Description of Artificial Sequence: Synthetic oligonucleotide
cagcagbhcvrmagtywcyctact

SEQ ID NO: 1432 - DNA, 24 bp, Artificial Sequence
  Description of Artificial Sequence: Synthetic oligonucleotide
cagcagtacvrmmbcywctwcact

SEQ ID NO: 1433 - DNA, 24 bp, Artificial Sequence
  Description of Artificial Sequence: Synthetic oligonucleotide
cagcagtacvrmmbcywcmtcact

SEQ ID NO: 1434 - DNA, 24 bp, Artificial Sequence
  Description of Artificial Sequence: Synthetic oligonucleotide
cagcagtacvrmmbcywcwggact

SEQ ID NO: 1435 - DNA, 24 bp, Artificial Sequence
  Description of Artificial Sequence: Synthetic oligonucleotide
cagcagtacvrmmbcywcyctact

SEQ ID NO: 1436 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttctwcact

SEQ ID NO: 1437 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttcmtcact

SEQ ID NO: 1438 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttcwggact

SEQ ID NO: 1439 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctact

SEQ ID NO: 1440 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywctwcact

SEQ ID NO: 1441 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywcmtcact

SEQ ID NO: 1442 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywcwggact

SEQ ID NO: 1443 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctact

SEQ ID NO: 1444 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywctwcact

SEQ ID NO: 1445 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywcmtcact

SEQ ID NO: 1446 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywcwggact

SEQ ID NO: 1447 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctact

SEQ ID NO: 1448 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywctwcact

SEQ ID NO: 1449 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywcmtcact

SEQ ID NO: 1450 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywcwggact

SEQ ID NO: 1451 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctact

SEQ ID NO: 1452 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctctwcact

SEQ ID NO: 1453 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctcmtcact

SEQ ID NO: 1454 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctcwggact

SEQ ID NO: 1455 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctact

SEQ ID NO: 1456 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywctwcact

SEQ ID NO: 1457 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywcmtcact

SEQ ID NO: 1458 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywcwggact

SEQ ID NO: 1459 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctact

SEQ ID NO: 1460 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywctwcact

SEQ ID NO: 1461 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywcmtcact

SEQ ID NO: 1462 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywcwggact

SEQ ID NO: 1463 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctact

SEQ ID NO: 1464 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywctwcact

SEQ ID NO: 1465 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywcmtcact

SEQ ID NO: 1466 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywcwggact

SEQ ID NO: 1467 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctact

SEQ ID NO: 1468 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcacttwcact

SEQ ID NO: 1469 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactmtcact

SEQ ID NO: 1470 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactwggact

SEQ ID NO: 1471 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctact

SEQ ID NO: 1472 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhctwcact

SEQ ID NO: 1473 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhcmtcact

SEQ ID NO: 1474 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhcwggact

SEQ ID NO: 1475 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctact

SEQ ID NO: 1476 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhctwcact

SEQ ID NO: 1477 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhcmtcact

SEQ ID NO: 1478 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhcwggact

SEQ ID NO: 1479 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctact

SEQ ID NO: 1480 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhctwcact

SEQ ID NO: 1481 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhcmtcact

SEQ ID NO: 1482 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhcwggact

SEQ ID NO: 1483 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctact

SEQ ID NO: 1484 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmacttwcact

SEQ ID NO: 1485 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactmtcact

SEQ ID NO: 1486 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactwggact

SEQ ID NO: 1487 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctact

SEQ ID NO: 1488 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbctwcact

SEQ ID NO: 1489 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbcmtcact

SEQ ID NO: 1490 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbcwggact

SEQ ID NO: 1491 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctact

SEQ ID NO: 1492 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbctwcact

SEQ ID NO: 1493 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbcmtcact

SEQ ID NO: 1494 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbcwggact

SEQ ID NO: 1495 - DNA, 24 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctact

SEQ ID NO: 1496 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbctwcact

SEQ ID NO: 1497 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbcmtcact

SEQ ID NO: 1498 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbcwggact

SEQ ID NO: 1499 - DNA, 24 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctact

SEQ ID NO: 1500 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggtwcact

SEQ ID NO: 1501 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggmtcact

SEQ ID NO: 1502 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggwggact

SEQ ID NO: 1503 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctact

SEQ ID NO: 1504 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywctwcact

SEQ ID NO: 1505 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywcmtcact

SEQ ID NO: 1506 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywcwggact

SEQ ID NO: 1507 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctact

SEQ ID NO: 1508 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywctwcact

SEQ ID NO: 1509 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywcmtcact

SEQ ID NO: 1510 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywcwggact

SEQ ID NO: 1511 - DNA, 24 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctact

SEQ ID NO: 1512 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywctwcact

SEQ ID NO: 1513 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywcmtcact

SEQ ID NO: 1514 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywcwggact

SEQ ID NO: 1515 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctact

SEQ ID NO: 1516 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagttwcact

SEQ ID NO: 1517 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtmtcact

SEQ ID NO: 1518 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtwggact

SEQ ID NO: 1519 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctact

SEQ ID NO: 1520 - DNA, 24 bp, Artificial Sequence
  Description of Artificial Sequence: Synthetic oligonucleotide
cagcagbhcbhcagtbhctwcact

SEQ ID NO: 1521 - DNA, 24 bp, Artificial Sequence
  Description of Artificial Sequence: Synthetic oligonucleotide
cagcagbhcbhcagtbhcmtcact

SEQ ID NO: 1522 - DNA, 24 bp, Artificial Sequence
  Description of Artificial Sequence: Synthetic oligonucleotide
cagcagbhcbhcagtbhcwggact

SEQ ID NO: 1523 - DNA, 24 bp, Artificial Sequence
  Description of Artificial Sequence: Synthetic oligonucleotide
cagcagbhcbhcagtbhccctact

SEQ ID NO: 1524 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhctwcact

SEQ ID NO: 1525 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhcmtcact

SEQ ID NO: 1526 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhcwggact

SEQ ID NO: 1527 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctact

SEQ ID NO: 1528 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhctwcact

SEQ ID NO: 1529 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhcmtcact

SEQ ID NO: 1530 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhcwggact

SEQ ID NO: 1531 - DNA, 24 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctact

SEQ ID NO: 1532 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcacttwcact

SEQ ID NO: 1533 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactmtcact

SEQ ID NO: 1534 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactwggact

SEQ ID NO: 1535 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctact

SEQ ID NO: 1536 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhctwcact

SEQ ID NO: 1537 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhcmtcact

SEQ ID NO: 1538 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhcwggact

SEQ ID NO: 1539 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctact

SEQ ID NO: 1540 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhctwcact

SEQ ID NO: 1541 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhcmtcact

SEQ ID NO: 1542 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhcwggact

SEQ ID NO: 1543 - DNA, 24 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctact

SEQ ID NO: 1544 - DNA, 72 bp, Artificial Sequence
  Description of Artificial Sequence: Synthetic oligonucleotide
cctgatgattttgcaacttattactgcswmswmtacaatagttacycttwcacttttggcggagggaccaag

SEQ ID NO: 1545 - DNA, 72 bp, Artificial Sequence
  Description of Artificial Sequence: Synthetic oligonucleotide
cctgatgattttgcaacttattactgccagcagbhcvrmagttacycttwcacttttggcggagggaccaag

SEQ ID NO: 1546 - DNA, 72 bp, Artificial Sequence
  Description of Artificial Sequence: Synthetic oligonucleotide
cctgatgattttgcaacttattactgccagcagbhcaatmbctacycttwcacttttggcggagggaccaag

SEQ ID NO: 1547 - DNA, 72 bp, Artificial Sequence
  Description of Artificial Sequence: Synthetic oligonucleotide
cctgatgattttgcaacttattactgccagcagbhcaatagtywcycttwcacttttggcggagggaccaag

SEQ ID NO: 1548 - DNA, 72 bp, Artificial Sequence
  Description of Artificial Sequence: Synthetic oligonucleotide
cctgatgattttgcaacttattactgccagcagtacvrmmbctacycttwcacttttggcggagggaccaag

SEQ ID NO: 1549 - DNA, 72 bp, Artificial Sequence
  Description of Artificial Sequence: Synthetic oligonucleotide
cctgatgattttgcaacttattactgccagcagtacvrmagtywcycttwcacttttggcggagggaccaag

SEQ ID NO: 1550 - DNA, 72 bp, Artificial Sequence
  Description of Artificial Sequence: Synthetic oligonucleotide
cctgatgattttgcaacttattactgccagcagtacaatmbcywcycttwcacttttggcggagggaccaag

SEQ ID NO: 1551 - DNA, 72 bp, Artificial Sequence
  Description of Artificial Sequence: Synthetic oligonucleotide
cctgatgattttgcaacttattactgcswmcagbhcaatagttacycttwcacttttggcggagggaccaag

SEQ ID NO: 1552 - DNA, 72 bp, Artificial Sequence
  Description of Artificial Sequence: Synthetic oligonucleotide
cctgatgattttgcaacttattactgcswmcagtacvrmagttacycttwcacttttggcggagggaccaag

SEQ ID NO: 1553 - DNA, 72 bp, Artificial Sequence
  Description of Artificial Sequence: Synthetic oligonucleotide
cctgatgattttgcaacttattactgcswmcagtacaatmbctacycttwcacttttggcggagggaccaag

SEQ ID NO: 1554 - DNA, 72 bp, Artificial Sequence
  Description of Artificial Sequence: Synthetic oligonucleotide
cctgatgattttgcaacttattactgcswmcagtacaatagtywcycttwcacttttggcggagggaccaag

SEQ ID NO: 1555 - DNA, 72 bp, Artificial Sequence
  Description of Artificial Sequence: Synthetic oligonucleotide
cctgatgattttgcaacttattactgccagswmbhcaatagttacycttwcacttttggcggagggaccaag

SEQ ID NO: 1556 - DNA, 72 bp, Artificial Sequence
  Description of Artificial Sequence: Synthetic oligonucleotide
cctgatgattttgcaacttattactgccagswmtacvrmagttacycttwcacttttggcggagggaccaag

SEQ ID NO: 1557 - DNA, 72 bp, Artificial Sequence
  Description of Artificial Sequence: Synthetic oligonucleotide
cctgatgattttgcaacttattactgccagswmtacaatmbctacycttwcacttttggcggagggaccaag

SEQ ID NO: 1558 - DNA, 72 bp, Artificial Sequence
  Description of Artificial Sequence: Synthetic oligonucleotide
cctgatgattttgcaacttattactgccagswmtacaatagtywcycttwcacttttggcggagggaccaag

SEQ ID NO: 1559 - DNA, 72 bp, Artificial Sequence
  Description of Artificial Sequence: Synthetic oligonucleotide
cctgatgattttgcaacttattactgcswmswmtacaatagttacyctmtcacttttggcggagggaccaag

SEQ ID NO: 1560 - DNA, 72 bp, Artificial Sequence
  Description of Artificial Sequence: Synthetic oligonucleotide
cctgatgattttgcaacttattactgccagcagbhcvrmagttacyctmtcacttttggcggagggaccaag

SEQ ID NO: 1561 - DNA, 72 bp, Artificial Sequence
  Description of Artificial Sequence: Synthetic oligonucleotide
cctgatgattttgcaacttattactgccagcagbhcaatmbctacyctmtcacttttggcggagggaccaag

SEQ ID NO: 1562 - DNA, 72 bp, Artificial Sequence
  Description of Artificial Sequence: Synthetic oligonucleotide
cctgatgattttgcaacttattactgccagcagbhcaatagtywcyctmtcacttttggcggagggaccaag

SEQ ID NO: 1563 - DNA, 72 bp, Artificial Sequence
  Description of Artificial Sequence: Synthetic oligonucleotide
cctgatgattttgcaacttattactgccagcagtacvrmmbctacyctmtcacttttggcggagggaccaag

SEQ ID NO: 1564 - DNA, 72 bp, Artificial Sequence
  Description of Artificial Sequence: Synthetic oligonucleotide
cctgatgattttgcaacttattactgccagcagtacvrmagtywcyctmtcacttttggcggagggaccaag

SEQ ID NO: 1565 - DNA, 72 bp, Artificial Sequence
  Description of Artificial Sequence: Synthetic oligonucleotide
cctgatgattttgcaacttattactgccagcagtacaatmbcywcyctmtcacttttggcggagggaccaag

SEQ ID NO: 1566 - DNA, 72 bp, Artificial Sequence
  Description of Artificial Sequence: Synthetic oligonucleotide
cctgatgattttgcaacttattactgcswmcagbhcaatagttacyctmtcacttttggcggagggaccaag

SEQ ID NO: 1567 - DNA, 72 bp, Artificial Sequence
  Description of Artificial Sequence: Synthetic oligonucleotide
cctgatgattttgcaacttattactgcswmcagtacvrmagttacyctmtcacttttggcggagggaccaag

SEQ ID NO: 1568 - DNA, 72 bp, Artificial Sequence
  Description of Artificial Sequence: Synthetic oligonucleotide
cctgatgattttgcaacttattactgcswmcagtacaatmbctacyctmtcacttttggcggagggaccaag

SEQ ID NO: 1569 - DNA, 72 bp, Artificial Sequence
  Description of Artificial Sequence: Synthetic oligonucleotide
cctgatgattttgcaacttattactgcswmcagtacaatagtywcyctmtcacttttggcggagggaccaag

SEQ ID NO: 1570 - DNA, 72 bp, Artificial Sequence
  Description of Artificial Sequence: Synthetic oligonucleotide
cctgatgattttgcaacttattactgccagswmbhcaatagttacyctmtcacttttggcggagggaccaag

SEQ ID NO: 1571 - DNA, 72 bp, Artificial Sequence
  Description of Artificial Sequence: Synthetic oligonucleotide
cctgatgattttgcaacttattactgccagswmtacvrmagttacyctmtcacttttggcggagggaccaag

SEQ ID NO: 1572 - DNA, 72 bp, Artificial Sequence
  Description of Artificial Sequence: Synthetic oligonucleotide
cctgatgattttgcaacttattactgccagswmtacaatmbctacyctmtcacttttggcggagggaccaag

SEQ ID NO: 1573 - DNA, 72 bp, Artificial Sequence
  Description of Artificial Sequence: Synthetic oligonucleotide
cctgatgattttgcaacttattactgccagswmtacaatagtywcyctmtcacttttggcggagggaccaag

SEQ ID NO: 1574 - DNA, 72 bp, Artificial Sequence
  Description of Artificial Sequence: Synthetic oligonucleotide
cctgatgattttgcaacttattactgcswmswmtacaatagttacyctwggacttttggcggagggaccaag

SEQ ID NO: 1575 - DNA, 72 bp, Artificial Sequence
  Description of Artificial Sequence: Synthetic oligonucleotide
cctgatgattttgcaacttattactgccagcagbhcvrmagttacyctwggacttttggcggagggaccaag

SEQ ID NO: 1576 - DNA, 72 bp, Artificial Sequence
  Description of Artificial Sequence: Synthetic oligonucleotide
cctgatgattttgcaacttattactgccagcagbhcaatmbctacyctwggacttttggcggagggaccaag

SEQ ID NO: 1577 - DNA, 72 bp, Artificial Sequence
  Description of Artificial Sequence: Synthetic oligonucleotide
cctgatgattttgcaacttattactgccagcagbhcaatagtywcyctwggacttttggcggagggaccaag

SEQ ID NO: 1578 - DNA, 72 bp, Artificial Sequence
  Description of Artificial Sequence: Synthetic oligonucleotide
cctgatgattttgcaacttattactgccagcagtacvrmmbctacyctwggacttttggcggagggaccaag

SEQ ID NO: 1579 - DNA, 72 bp, Artificial Sequence
  Description of Artificial Sequence: Synthetic oligonucleotide
cctgatgattttgcaacttattactgccagcagtacvrmagtywcyctwggacttttggcggagggaccaag

SEQ ID NO: 1580 - DNA, 72 bp, Artificial Sequence
  Description of Artificial Sequence: Synthetic oligonucleotide
cctgatgattttgcaacttattactgccagcagtacaatmbcywcyctwggacttttggcggagggaccaag

SEQ ID NO: 1581 - DNA, 72 bp, Artificial Sequence
  Description of Artificial Sequence: Synthetic oligonucleotide
cctgatgattttgcaacttattactgcswmcagbhcaatagttacyctwggacttttggcggagggaccaag

SEQ ID NO: 1582 - DNA, 72 bp, Artificial Sequence
  Description of Artificial Sequence: Synthetic oligonucleotide
cctgatgattttgcaacttattactgcswmcagtacvrmagttacyctwggacttttggcggagggaccaag

SEQ ID NO: 1583 - DNA, 72 bp, Artificial Sequence
  Description of Artificial Sequence: Synthetic oligonucleotide
cctgatgattttgcaacttattactgcswmcagtacaatmbctacyctwggacttttggcggagggaccaag

SEQ ID NO: 1584 - DNA, 72 bp, Artificial Sequence
  Description of Artificial Sequence: Synthetic oligonucleotide
cctgatgattttgcaacttattactgcswmcagtacaatagtywcyctwggacttttggcggagggaccaag

SEQ ID NO: 1585 - DNA, 72 bp, Artificial Sequence
  Description of Artificial Sequence: Synthetic oligonucleotide
cctgatgattttgcaacttattactgccagswmbhcaatagttacyctwggacttttggcggagggaccaag

SEQ ID NO: 1586 - DNA, 72 bp, Artificial Sequence
  Description of Artificial Sequence: Synthetic oligonucleotide
cctgatgattttgcaacttattactgccagswmtacvrmagttacyctwggacttttggcggagggaccaag

SEQ ID NO: 1587 - DNA, 72 bp, Artificial Sequence
  Description of Artificial Sequence: Synthetic oligonucleotide
cctgatgattttgcaacttattactgccagswmtacaatmbctacyctwggacttttggcggagggaccaag

SEQ ID NO: 1588 - DNA, 72 bp, Artificial Sequence
  Description of Artificial Sequence: Synthetic oligonucleotide
cctgatgattttgcaacttattactgccagswmtacaatagtywcyctwggacttttggcggagggaccaag

SEQ ID NO: 1589 - DNA, 72 bp, Artificial Sequence
  Description of Artificial Sequence: Synthetic oligonucleotide
cctgatgattttgcaacttattactgcswmswmtacaatagttacyctcctacttttggcggagggaccaag

SEQ ID NO: 1590 - DNA, 72 bp, Artificial Sequence
  Description of Artificial Sequence: Synthetic oligonucleotide
cctgatgattttgcaacttattactgccagcagbhcvrmagttacyctcctacttttggcggagggaccaag

SEQ ID NO: 1591 - DNA, 72 bp, Artificial Sequence
  Description of Artificial Sequence: Synthetic oligonucleotide
cctgatgattttgcaacttattactgccagcagbhcaatmbctacyctcctacttttggcggagggaccaag

SEQ ID NO: 1592 - DNA, 72 bp, Artificial Sequence
  Description of Artificial Sequence: Synthetic oligonucleotide
cctgatgattttgcaacttattactgccagcagbhcaatagtywcyctcctacttttggcggagggaccaag

SEQ ID NO: 1593 - DNA, 72 bp, Artificial Sequence
  Description of Artificial Sequence: Synthetic oligonucleotide
cctgatgattttgcaacttattactgccagcagtacvrmmbctacyctcctacttttggcggagggaccaag

SEQ ID NO: 1594 - DNA, 72 bp, Artificial Sequence
  Description of Artificial Sequence: Synthetic oligonucleotide
cctgatgattttgcaacttattactgccagcagtacvrmagtywcyctcctacttttggcggagggaccaag

SEQ ID NO: 1595 - DNA, 72 bp, Artificial Sequence
  Description of Artificial Sequence: Synthetic oligonucleotide
cctgatgattttgcaacttattactgccagcagtacaatmbcywcyctcctacttttggcggagggaccaag

SEQ ID NO: 1596 - DNA, 72 bp, Artificial Sequence
  Description of Artificial Sequence: Synthetic oligonucleotide
cctgatgattttgcaacttattactgcswmcagbhcaatagttacyctcctacttttggcggagggaccaag

SEQ ID NO: 1597 - DNA, 72 bp, Artificial Sequence
  Description of Artificial Sequence: Synthetic oligonucleotide
cctgatgattttgcaacttattactgcswmcagtacvrmagttacyctcctacttttggcggagggaccaag

SEQ ID NO: 1598 - DNA, 72 bp, Artificial Sequence
  Description of Artificial Sequence: Synthetic oligonucleotide
cctgatgattttgcaacttattactgcswmcagtacaatmbctacyctcctacttttggcggagggaccaag

SEQ ID NO: 1599 - DNA, 72 bp, Artificial Sequence
  Description of Artificial Sequence: Synthetic oligonucleotide
cctgatgattttgcaacttattactgcswmcagtacaatagtywcyctcctacttttggcggagggaccaag

SEQ ID NO: 1600 - DNA, 72 bp, Artificial Sequence
  Description of Artificial Sequence: Synthetic oligonucleotide
cctgatgattttgcaacttattactgccagswmbhcaatagttacyctcctacttttggcggagggaccaag

SEQ ID NO: 1601 - DNA, 72 bp, Artificial Sequence
  Description of Artificial Sequence: Synthetic oligonucleotide
cctgatgattttgcaacttattactgccagswmtacvrmagttacyctcctacttttggcggagggaccaag

SEQ ID NO: 1602 - DNA, 72 bp, Artificial Sequence
  Description of Artificial Sequence: Synthetic oligonucleotide
cctgatgattttgcaacttattactgccagswmtacaatmbctacyctcctacttttggcggagggaccaag

SEQ ID NO: 1603 - DNA, 72 bp, Artificial Sequence
  Description of Artificial Sequence: Synthetic oligonucleotide
cctgatgattttgcaacttattactgccagswmtacaatagtywcyctcctacttttggcggagggaccaag

SEQ ID NO: 1604 - DNA, 72 bp, Artificial Sequence
  Description of Artificial Sequence: Synthetic oligonucleotide
cctgaagattttgcaacttattactgtswmswmgcaaatagtttcccttwcacttttggcggagggaccaag

SEQ ID NO: 1605 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttcccttwcacttttggcggagggaccaag

SEQ ID NO: 1606 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttcccttwcacttttggcggagggaccaag

SEQ ID NO: 1607 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywcccttwcacttttggcggagggaccaag

SEQ ID NO: 1608 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttcccttwcacttttggcggagggaccaag

SEQ ID NO: 1609 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywcccttwcacttttggcggagggaccaag

SEQ ID NO: 1610 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywcccttwcacttttggcggagggaccaag

SEQ ID NO: 1611 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttcccttwcacttttggcggagggaccaag

SEQ ID NO: 1612 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttcccttwcacttttggcggagggaccaag

SEQ ID NO: 1613 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttcccttwcacttttggcggagggaccaag

SEQ ID NO: 1614 - DNA, 72 bp, Artificial Sequence
  Description of Artificial Sequence: Synthetic oligonucleotide
cctgaagattttgcaacttattactgtswmcaggcaaatagtywcccttwcacttttggcggagggaccaag

SEQ ID NO: 1615 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttcccttwcacttttggcggagggaccaag

SEQ ID NO: 1616 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttcccttwcacttttggcggagggaccaag

SEQ ID NO: 1617 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttcccttwcacttttggcggagggaccaag

SEQ ID NO: 1618 - DNA, 72 bp, Artificial Sequence
  Description of Artificial Sequence: Synthetic oligonucleotide
cctgaagattttgcaacttattactgtcagswmgcaaatagtywcccttwcacttttggcggagggaccaag

SEQ ID NO: 1619 - DNA, 72 bp, Artificial Sequence
  Description of Artificial Sequence: Synthetic oligonucleotide
cctgaagattttgcaacttattactgtswmswmgcaaatagtttccctmtcacttttggcggagggaccaag

SEQ ID NO: 1620 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctmtcacttttggcggagggaccaag

SEQ ID NO: 1621 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctmtcacttttggcggagggaccaag

SEQ ID NO: 1622 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctmtcacttttggcggagggaccaag

SEQ ID NO: 1623 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctmtcacttttggcggagggaccaag

SEQ ID NO: 1624 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctmtcacttttggcggagggaccaag

SEQ ID NO: 1625 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctmtcacttttggcggagggaccaag

SEQ ID NO: 1626 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctmtcacttttggcggagggaccaag

SEQ ID NO: 1627 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctmtcacttttggcggagggaccaag

SEQ ID NO: 1628 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctmtcacttttggcggagggaccaag

SEQ ID NO: 1629 - DNA, 72 bp, Artificial Sequence
  Description of Artificial Sequence: Synthetic oligonucleotide
cctgaagattttgcaacttattactgtswmcaggcaaatagtywccctmtcacttttggcggagggaccaag

SEQ ID NO: 1630 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctmtcacttttggcggagggaccaag

SEQ ID NO: 1631 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctmtcacttttggcggagggaccaag

SEQ ID NO: 1632 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctmtcacttttggcggagggaccaag

SEQ ID NO: 1633 - DNA, 72 bp, Artificial Sequence
  Description of Artificial Sequence: Synthetic oligonucleotide
cctgaagattttgcaacttattactgtcagswmgcaaatagtywccctmtcacttttggcggagggaccaag

SEQ ID NO: 1634 - DNA, 72 bp, Artificial Sequence
  Description of Artificial Sequence: Synthetic oligonucleotide
cctgaagattttgcaacttattactgtswmswmgcaaatagtttccctwggacttttggcggagggaccaag

SEQ ID NO: 1635 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctwggacttttggcggagggaccaag

SEQ ID NO: 1636 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctwggacttttggcggagggaccaag

SEQ ID NO: 1637 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctwggacttttggcggagggaccaag

SEQ ID NO: 1638 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctwggacttttggcggagggaccaag

SEQ ID NO: 1639 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctwggacttttggcggagggaccaag

SEQ ID NO: 1640 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctwggacttttggcggagggaccaag

SEQ ID NO: 1641 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctwggacttttggcggagggaccaag

SEQ ID NO: 1642 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctwggacttttggcggagggaccaag

SEQ ID NO: 1643 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctwggacttttggcggagggaccaag

SEQ ID NO: 1644 - DNA, 72 bp, Artificial Sequence
  Description of Artificial Sequence: Synthetic oligonucleotide
cctgaagattttgcaacttattactgtswmcaggcaaatagtywccctwggacttttggcggagggaccaag

SEQ ID NO: 1645 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctwggacttttggcggagggaccaag

SEQ ID NO: 1646 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctwggacttttggcggagggaccaag

SEQ ID NO: 1647 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctwggacttttggcggagggaccaag

SEQ ID NO: 1648 - DNA, 72 bp, Artificial Sequence
  Description of Artificial Sequence: Synthetic oligonucleotide
cctgaagattttgcaacttattactgtcagswmgcaaatagtywccctwggacttttggcggagggaccaag

SEQ ID NO: 1649 - DNA, 72 bp, Artificial Sequence
  Description of Artificial Sequence: Synthetic oligonucleotide
cctgaagattttgcaacttattactgtswmswmgcaaatagtttccctcctacttttggcggagggaccaag

SEQ ID NO: 1650 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctcctacttttggcggagggaccaag

SEQ ID NO: 1651 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctcctacttttggcggagggaccaag

SEQ ID NO: 1652 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctcctacttttggcggagggaccaag

SEQ ID NO: 1653 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctcctacttttggcggagggaccaag

SEQ ID NO: 1654 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctcctacttttggcggagggaccaag

SEQ ID NO: 1655 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctcctacttttggcggagggaccaag

SEQ ID NO: 1656 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctcctacttttggcggagggaccaag

SEQ ID NO: 1657 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctcctacttttggcggagggaccaag

SEQ ID NO: 1658 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctcctacttttggcggagggaccaag

SEQ ID NO: 1659 - DNA, 72 bp, Artificial Sequence
  Description of Artificial Sequence: Synthetic oligonucleotide
cctgaagattttgcaacttattactgtswmcaggcaaatagtywccctcctacttttggcggagggaccaag

SEQ ID NO: 1660 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctcctacttttggcggagggaccaag

SEQ ID NO: 1661 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctcctacttttggcggagggaccaag

SEQ ID NO: 1662 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctcctacttttggcggagggaccaag

SEQ ID NO: 1663 - DNA, 72 bp, Artificial Sequence
  Description of Artificial Sequence: Synthetic oligonucleotide
cctgaagattttgcaacttattactgtcagswmgcaaatagtywccctcctacttttggcggagggaccaag

SEQ ID NO: 1664 - DNA, 72 bp, Artificial Sequence
  Description of Artificial Sequence: Synthetic oligonucleotide
cctgaagatattgcaacatattactgtswmswmtacgataatctcccttwcacttttggcggagggaccaag

SEQ ID NO: 1665 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctcccttwcacttttggcggagggaccaag

SEQ ID NO: 1666 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctcccttwcacttttggcggagggaccaag

SEQ ID NO: 1667 - DNA, 72 bp, Artificial Sequence
  Description of Artificial Sequence: Synthetic oligonucleotide
cctgaagatattgcaacatattactgtcagcagbhcgataatywcccttwcacttttggcggagggaccaag

SEQ ID NO: 1668 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctcccttwcacttttggcggagggaccaag

SEQ ID NO: 1669 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywcccttwcacttttggcggagggaccaag

SEQ ID NO: 1670 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywcccttwcacttttggcggagggaccaag

SEQ ID NO: 1671 - DNA, 72 bp, Artificial Sequence
  Description of Artificial Sequence: Synthetic oligonucleotide
cctgaagatattgcaacatattactgtswmcagbhcgataatctcccttwcacttttggcggagggaccaag

SEQ ID NO: 1672 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctcccttwcacttttggcggagggaccaag

SEQ ID NO: 1673 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctcccttwcacttttggcggagggaccaag

SEQ ID NO: 1674 - DNA, 72 bp, Artificial Sequence
  Description of Artificial Sequence: Synthetic oligonucleotide
cctgaagatattgcaacatattactgtswmcagtacgataatywcccttwcacttttggcggagggaccaag

SEQ ID NO: 1675 - DNA, 72 bp, Artificial Sequence
  Description of Artificial Sequence: Synthetic oligonucleotide
cctgaagatattgcaacatattactgtcagswmbhcgataatctcccttwcacttttggcggagggaccaag

SEQ ID NO: 1676 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctcccttwcacttttggcggagggaccaag

SEQ ID NO: 1677 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctcccttwcacttttggcggagggaccaag

SEQ ID NO: 1678 - DNA, 72 bp, Artificial Sequence
  Description of Artificial Sequence: Synthetic oligonucleotide
cctgaagatattgcaacatattactgtcagswmtacgataatywcccttwcacttttggcggagggaccaag

SEQ ID NO: 1679 - DNA, 72 bp, Artificial Sequence
  Description of Artificial Sequence: Synthetic oligonucleotide
cctgaagatattgcaacatattactgtswmswmtacgataatctccctmtcacttttggcggagggaccaag

SEQ ID NO: 1680 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctmtcacttttggcggagggaccaag

SEQ ID NO: 1681 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctmtcacttttggcggagggaccaag

SEQ ID NO: 1682 - DNA, 72 bp, Artificial Sequence
  Description of Artificial Sequence: Synthetic oligonucleotide
cctgaagatattgcaacatattactgtcagcagbhcgataatywccctmtcacttttggcggagggaccaag

SEQ ID NO: 1683 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctmtcacttttggcggagggaccaag

SEQ ID NO: 1684 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctmtcacttttggcggagggaccaag

SEQ ID NO: 1685 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctmtcacttttggcggagggaccaag

SEQ ID NO: 1686 - DNA, 72 bp, Artificial Sequence
  Description of Artificial Sequence: Synthetic oligonucleotide
cctgaagatattgcaacatattactgtswmcagbhcgataatctccctmtcacttttggcggagggaccaag

SEQ ID NO: 1687 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctmtcacttttggcggagggaccaag

SEQ ID NO: 1688 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctmtcacttttggcggagggaccaag

SEQ ID NO: 1689 - DNA, 72 bp, Artificial Sequence
  Description of Artificial Sequence: Synthetic oligonucleotide
cctgaagatattgcaacatattactgtswmcagtacgataatywccctmtcacttttggcggagggaccaag

SEQ ID NO: 1690 - DNA, 72 bp, Artificial Sequence
  Description of Artificial Sequence: Synthetic oligonucleotide
cctgaagatattgcaacatattactgtcagswmbhcgataatctccctmtcacttttggcggagggaccaag

SEQ ID NO: 1691 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctmtcacttttggcggagggaccaag

SEQ ID NO: 1692 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctmtcacttttggcggagggaccaag

SEQ ID NO: 1693 - DNA, 72 bp, Artificial Sequence
  Description of Artificial Sequence: Synthetic oligonucleotide
cctgaagatattgcaacatattactgtcagswmtacgataatywccctmtcacttttggcggagggaccaag

SEQ ID NO: 1694 - DNA, 72 bp, Artificial Sequence
  Description of Artificial Sequence: Synthetic oligonucleotide
cctgaagatattgcaacatattactgtswmswmtacgataatctccctwggacttttggcggagggaccaag

SEQ ID NO: 1695 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctwggacttttggcggagggaccaag

SEQ ID NO: 1696 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctwggacttttggcggagggaccaag

SEQ ID NO: 1697 - DNA, 72 bp, Artificial Sequence
  Description of Artificial Sequence: Synthetic oligonucleotide
cctgaagatattgcaacatattactgtcagcagbhcgataatywccctwggacttttggcggagggaccaag

SEQ ID NO: 1698 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctwggacttttggcggagggaccaag

SEQ ID NO: 1699 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctwggacttttggcggagggaccaag

SEQ ID NO: 1700 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctwggacttttggcggagggaccaag

SEQ ID NO: 1701 - DNA, 72 bp, Artificial Sequence
  Description of Artificial Sequence: Synthetic oligonucleotide
cctgaagatattgcaacatattactgtswmcagbhcgataatctccctwggacttttggcggagggaccaag

SEQ ID NO: 1702 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctwggacttttggcggagggaccaag

SEQ ID NO: 1703 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctwggacttttggcggagggaccaag

SEQ ID NO: 1704 - DNA, 72 bp, Artificial Sequence
  Description of Artificial Sequence: Synthetic oligonucleotide
cctgaagatattgcaacatattactgtswmcagtacgataatywccctwggacttttggcggagggaccaag

SEQ ID NO: 1705 - DNA, 72 bp, Artificial Sequence
  Description of Artificial Sequence: Synthetic oligonucleotide
cctgaagatattgcaacatattactgtcagswmbhcgataatctccctwggacttttggcggagggaccaag

SEQ ID NO: 1706 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctwggacttttggcggagggaccaag

SEQ ID NO: 1707 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctwggacttttggcggagggaccaag

SEQ ID NO: 1708 - DNA, 72 bp, Artificial Sequence
  Description of Artificial Sequence: Synthetic oligonucleotide
cctgaagatattgcaacatattactgtcagswmtacgataatywccctwggacttttggcggagggaccaag

SEQ ID NO: 1709 - DNA, 72 bp, Artificial Sequence
  Description of Artificial Sequence: Synthetic oligonucleotide
cctgaagatattgcaacatattactgtswmswmtacgataatctccctcctacttttggcggagggaccaag

SEQ ID NO: 1710 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctcctacttttggcggagggaccaag

SEQ ID NO: 1711 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctcctacttttggcggagggaccaag

SEQ ID NO: 1712 - DNA, 72 bp, Artificial Sequence
  Description of Artificial Sequence: Synthetic oligonucleotide
cctgaagatattgcaacatattactgtcagcagbhcgataatywccctcctacttttggcggagggaccaag

SEQ ID NO: 1713 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctcctacttttggcggagggaccaag

SEQ ID NO: 1714 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctcctacttttggcggagggaccaag

SEQ ID NO: 1715 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctcctacttttggcggagggaccaag

SEQ ID NO: 1716 - DNA, 72 bp, Artificial Sequence
  Description of Artificial Sequence: Synthetic oligonucleotide
cctgaagatattgcaacatattactgtswmcagbhcgataatctccctcctacttttggcggagggaccaag

SEQ ID NO: 1717 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctcctacttttggcggagggaccaag

SEQ ID NO: 1718 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctcctacttttggcggagggaccaag

SEQ ID NO: 1719 - DNA, 72 bp, Artificial Sequence
  Description of Artificial Sequence: Synthetic oligonucleotide
cctgaagatattgcaacatattactgtswmcagtacgataatywccctcctacttttggcggagggaccaag

SEQ ID NO: 1720 - DNA, 72 bp, Artificial Sequence
  Description of Artificial Sequence: Synthetic oligonucleotide
cctgaagatattgcaacatattactgtcagswmbhcgataatctccctcctacttttggcggagggaccaag

SEQ ID NO: 1721 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctcctacttttggcggagggaccaag

SEQ ID NO: 1722 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctcctacttttggcggagggaccaag

SEQ ID NO: 1723 - DNA, 72 bp, Artificial Sequence
  Description of Artificial Sequence: Synthetic oligonucleotide
cctgaagatattgcaacatattactgtcagswmtacgataatywccctcctacttttggcggagggaccaag

SEQ ID NO: 1724 - DNA, 72 bp, Artificial Sequence
  Description of Artificial Sequence: Synthetic oligonucleotide
cctgaagattttgcaacttactactgtswmswmagctacagtactccttwcacttttggcggagggaccaag

SEQ ID NO: 1725 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactccttwcacttttggcggagggaccaag

SEQ ID NO: 1726 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactccttwcacttttggcggagggaccaag

SEQ ID NO: 1727 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhcccttwcacttttggcggagggaccaag

SEQ ID NO: 1728 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactccttwcacttttggcggagggaccaag

SEQ ID NO: 1729 - DNA, 72 bp, Artificial Sequence
  Description of Artificial Sequence: Synthetic oligonucleotide
cctgaagattttgcaacttactactgtcagcaaagcbhcagtbhcccttwcacttttggcggagggaccaag

SEQ ID NO: 1730 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhcccttwcacttttggcggagggaccaag

SEQ ID NO: 1731 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactccttwcacttttggcggagggaccaag

SEQ ID NO: 1732 - DNA, 72 bp, Artificial Sequence
  Description of Artificial Sequence: Synthetic oligonucleotide
cctgaagattttgcaacttactactgtswmcaaagcbhcagtactccttwcacttttggcggagggaccaag

SEQ ID NO: 1733 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactccttwcacttttggcggagggaccaag

SEQ ID NO: 1734 - DNA, 72 bp, Artificial Sequence
  Description of Artificial Sequence: Synthetic oligonucleotide
cctgaagattttgcaacttactactgtswmcaaagctacagtbhcccttwcacttttggcggagggaccaag

SEQ ID NO: 1735 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactccttwcacttttggcggagggaccaag

SEQ ID NO: 1736 - DNA, 72 bp, Artificial Sequence
  Description of Artificial Sequence: Synthetic oligonucleotide
cctgaagattttgcaacttactactgtcagswmagcbhcagtactccttwcacttttggcggagggaccaag

SEQ ID NO: 1737 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactccttwcacttttggcggagggaccaag

SEQ ID NO: 1738 - DNA, 72 bp, Artificial Sequence
  Description of Artificial Sequence: Synthetic oligonucleotide
cctgaagattttgcaacttactactgtcagswmagctacagtbhcccttwcacttttggcggagggaccaag

SEQ ID NO: 1739 - DNA, 72 bp, Artificial Sequence
  Description of Artificial Sequence: Synthetic oligonucleotide
cctgaagattttgcaacttactactgtswmswmagctacagtactcctmtcacttttggcggagggaccaag

SEQ ID NO: 1740 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctmtcacttttggcggagggaccaag

SEQ ID NO: 1741 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctmtcacttttggcggagggaccaag

SEQ ID NO: 1742 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctmtcacttttggcggagggaccaag

SEQ ID NO: 1743 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctmtcacttttggcggagggaccaag

SEQ ID NO: 1744 - DNA, 72 bp, Artificial Sequence
  Description of Artificial Sequence: Synthetic oligonucleotide
cctgaagattttgcaacttactactgtcagcaaagcbhcagtbhccctmtcacttttggcggagggaccaag

SEQ ID NO: 1745 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctmtcacttttggcggagggaccaag

SEQ ID NO: 1746 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctmtcacttttggcggagggaccaag

SEQ ID NO: 1747 - DNA, 72 bp, Artificial Sequence
  Description of Artificial Sequence: Synthetic oligonucleotide
cctgaagattttgcaacttactactgtswmcaaagcbhcagtactcctmtcacttttggcggagggaccaag

SEQ ID NO: 1748 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctmtcacttttggcggagggaccaag

SEQ ID NO: 1749 - DNA, 72 bp, Artificial Sequence
  Description of Artificial Sequence: Synthetic oligonucleotide
cctgaagattttgcaacttactactgtswmcaaagctacagtbhccctmtcacttttggcggagggaccaag

SEQ ID NO: 1750 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctmtcacttttggcggagggaccaag

SEQ ID NO: 1751 - DNA, 72 bp, Artificial Sequence
  Description of Artificial Sequence: Synthetic oligonucleotide
cctgaagattttgcaacttactactgtcagswmagcbhcagtactcctmtcacttttggcggagggaccaag

SEQ ID NO: 1752 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctmtcacttttggcggagggaccaag

SEQ ID NO: 1753 - DNA, 72 bp, Artificial Sequence
  Description of Artificial Sequence: Synthetic oligonucleotide
cctgaagattttgcaacttactactgtcagswmagctacagtbhccctmtcacttttggcggagggaccaag

SEQ ID NO: 1754 - DNA, 72 bp, Artificial Sequence
  Description of Artificial Sequence: Synthetic oligonucleotide
cctgaagattttgcaacttactactgtswmswmagctacagtactcctwggacttttggcggagggaccaag

SEQ ID NO: 1755 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctwggacttttggcggagggaccaag

SEQ ID NO: 1756 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctwggacttttggcggagggaccaag

SEQ ID NO: 1757 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctwggacttttggcggagggaccaag

SEQ ID NO: 1758 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctwggacttttggcggagggaccaag

SEQ ID NO: 1759 - DNA, 72 bp, Artificial Sequence
  Description of Artificial Sequence: Synthetic oligonucleotide
cctgaagattttgcaacttactactgtcagcaaagcbhcagtbhccctwggacttttggcggagggaccaag

SEQ ID NO: 1760 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctwggacttttggcggagggaccaag

SEQ ID NO: 1761 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctwggacttttggcggagggaccaag

SEQ ID NO: 1762 - DNA, 72 bp, Artificial Sequence
  Description of Artificial Sequence: Synthetic oligonucleotide
cctgaagattttgcaacttactactgtswmcaaagcbhcagtactcctwggacttttggcggagggaccaag

SEQ ID NO: 1763 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctwggacttttggcggagggaccaag

SEQ ID NO: 1764 - DNA, 72 bp, Artificial Sequence
  Description of Artificial Sequence: Synthetic oligonucleotide
cctgaagattttgcaacttactactgtswmcaaagctacagtbhccctwggacttttggcggagggaccaag

SEQ ID NO: 1765 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctwggacttttggcggagggaccaag

SEQ ID NO: 1766 - DNA, 72 bp, Artificial Sequence
  Description of Artificial Sequence: Synthetic oligonucleotide
cctgaagattttgcaacttactactgtcagswmagcbhcagtactcctwggacttttggcggagggaccaag

SEQ ID NO: 1767 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctwggacttttggcggagggaccaag

SEQ ID NO: 1768 - DNA, 72 bp, Artificial Sequence
  Description of Artificial Sequence: Synthetic oligonucleotide
cctgaagattttgcaacttactactgtcagswmagctacagtbhccctwggacttttggcggagggaccaag

SEQ ID NO: 1769 - DNA, 72 bp, Artificial Sequence
  Description of Artificial Sequence: Synthetic oligonucleotide
cctgaagattttgcaacttactactgtswmswmagctacagtactcctcctacttttggcggagggaccaag

SEQ ID NO: 1770 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctcctacttttggcggagggaccaag

SEQ ID NO: 1771 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctcctacttttggcggagggaccaag

SEQ ID NO: 1772 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctcctacttttggcggagggaccaag

SEQ ID NO: 1773 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctcctacttttggcggagggaccaag

SEQ ID NO: 1774 - DNA, 72 bp, Artificial Sequence
  Description of Artificial Sequence: Synthetic oligonucleotide
cctgaagattttgcaacttactactgtcagcaaagcbhcagtbhccctcctacttttggcggagggaccaag

SEQ ID NO: 1775 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctcctacttttggcggagggaccaag

SEQ ID NO: 1776 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctcctacttttggcggagggaccaag

SEQ ID NO: 1777 - DNA, 72 bp, Artificial Sequence
  Description of Artificial Sequence: Synthetic oligonucleotide
cctgaagattttgcaacttactactgtswmcaaagcbhcagtactcctcctacttttggcggagggaccaag

SEQ ID NO: 1778 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctcctacttttggcggagggaccaag

SEQ ID NO: 1779 - DNA, 72 bp, Artificial Sequence
  Description of Artificial Sequence: Synthetic oligonucleotide
cctgaagattttgcaacttactactgtswmcaaagctacagtbhccctcctacttttggcggagggaccaag

SEQ ID NO: 1780 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctcctacttttggcggagggaccaag

SEQ ID NO: 1781 - DNA, 72 bp, Artificial Sequence
  Description of Artificial Sequence: Synthetic oligonucleotide
cctgaagattttgcaacttactactgtcagswmagcbhcagtactcctcctacttttggcggagggaccaag

SEQ ID NO: 1782 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctcctacttttggcggagggaccaag

SEQ ID NO: 1783 - DNA, 72 bp, Artificial Sequence
  Description of Artificial Sequence: Synthetic oligonucleotide
cctgaagattttgcaacttactactgtcagswmagctacagtbhccctcctacttttggcggagggaccaag

SEQ ID NO: 1784 - DNA, 72 bp, Artificial Sequence
  Description of Artificial Sequence: Synthetic oligonucleotide
gctgaggatgttggggtttattactgcdtsswmgcactccagactccttwcacttttggcggagggaccaag

SEQ ID NO: 1785 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactccttwcacttttggcggagggaccaag

SEQ ID NO: 1786 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactccttwcacttttggcggagggaccaag

SEQ ID NO: 1787 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbcccttwcacttttggcggagggaccaag

SEQ ID NO: 1788 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactccttwcacttttggcggagggaccaag

SEQ ID NO: 1789 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbcccttwcacttttggcggagggaccaag

SEQ ID NO: 1790 - DNA, 72 bp, Artificial Sequence
  Description of Artificial Sequence: Synthetic oligonucleotide
gctgaggatgttggggtttattactgcatgcaggcactcsrmvbcccttwcacttttggcggagggaccaag

SEQ ID NO: 1791 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactccttwcacttttggcggagggaccaag

SEQ ID NO: 1792 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactccttwcacttttggcggagggaccaag

SEQ ID NO: 1793 - DNA, 72 bp, Artificial Sequence
  Description of Artificial Sequence: Synthetic oligonucleotide
gctgaggatgttggggtttattactgcdtscaggcactcsrmactccttwcacttttggcggagggaccaag

SEQ ID NO: 1794 - DNA, 72 bp, Artificial Sequence
  Description of Artificial Sequence: Synthetic oligonucleotide
gctgaggatgttggggtttattactgcdtscaggcactccagvbcccttwcacttttggcggagggaccaag

SEQ ID NO: 1795 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactccttwcacttttggcggagggaccaag

SEQ ID NO: 1796 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactccttwcacttttggcggagggaccaag

SEQ ID NO: 1797 - DNA, 72 bp, Artificial Sequence
  Description of Artificial Sequence: Synthetic oligonucleotide
gctgaggatgttggggtttattactgcatgswmgcactcsrmactccttwcacttttggcggagggaccaag

SEQ ID NO: 1798 - DNA, 72 bp, Artificial Sequence
  Description of Artificial Sequence: Synthetic oligonucleotide
gctgaggatgttggggtttattactgcatgswmgcactccagvbcccttwcacttttggcggagggaccaag

SEQ ID NO: 1799 - DNA, 72 bp, Artificial Sequence
  Description of Artificial Sequence: Synthetic oligonucleotide
gctgaggatgttggggtttattactgcdtsswmgcactccagactcctmtcacttttggcggagggaccaag

SEQ ID NO: 1800 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctmtcacttttggcggagggaccaag

SEQ ID NO: 1801 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctmtcacttttggcggagggaccaag

SEQ ID NO: 1802 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctmtcacttttggcggagggaccaag

SEQ ID NO: 1803 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctmtcacttttggcggagggaccaag

SEQ ID NO: 1804 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctmtcacttttggcggagggaccaag

SEQ ID NO: 1805 - DNA, 72 bp, Artificial Sequence
  Description of Artificial Sequence: Synthetic oligonucleotide
gctgaggatgttggggtttattactgcatgcaggcactcsrmvbccctmtcacttttggcggagggaccaag

SEQ ID NO: 1806 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctmtcacttttggcggagggaccaag

SEQ ID NO: 1807 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctmtcacttttggcggagggaccaag

SEQ ID NO: 1808 - DNA, 72 bp, Artificial Sequence
  Description of Artificial Sequence: Synthetic oligonucleotide
gctgaggatgttggggtttattactgcdtscaggcactcsrmactcctmtcacttttggcggagggaccaag

SEQ ID NO: 1809 - DNA, 72 bp, Artificial Sequence
  Description of Artificial Sequence: Synthetic oligonucleotide
gctgaggatgttggggtttattactgcdtscaggcactccagvbccctmtcacttttggcggagggaccaag

SEQ ID NO: 1810 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctmtcacttttggcggagggaccaag

SEQ ID NO: 1811 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctmtcacttttggcggagggaccaag

SEQ ID NO: 1812 - DNA, 72 bp, Artificial Sequence
  Description of Artificial Sequence: Synthetic oligonucleotide
gctgaggatgttggggtttattactgcatgswmgcactcsrmactcctmtcacttttggcggagggaccaag

SEQ ID NO: 1813 - DNA, 72 bp, Artificial Sequence
  Description of Artificial Sequence: Synthetic oligonucleotide
gctgaggatgttggggtttattactgcatgswmgcactccagvbccctmtcacttttggcggagggaccaag

SEQ ID NO: 1814 - DNA, 72 bp, Artificial Sequence
  Description of Artificial Sequence: Synthetic oligonucleotide
gctgaggatgttggggtttattactgcdtsswmgcactccagactcctwggacttttggcggagggaccaag

SEQ ID NO: 1815 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctwggacttttggcggagggaccaag

SEQ ID NO: 1816 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctwggacttttggcggagggaccaag

SEQ ID NO: 1817 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctwggacttttggcggagggaccaag

SEQ ID NO: 1818 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctwggacttttggcggagggaccaag

SEQ ID NO: 1819 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctwggacttttggcggagggaccaag

SEQ ID NO: 1820 - DNA, 72 bp, Artificial Sequence
  Description of Artificial Sequence: Synthetic oligonucleotide
gctgaggatgttggggtttattactgcatgcaggcactcsrmvbccctwggacttttggcggagggaccaag

SEQ ID NO: 1821 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctwggacttttggcggagggaccaag

SEQ ID NO: 1822 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctwggacttttggcggagggaccaag

SEQ ID NO: 1823 - DNA, 72 bp, Artificial Sequence
  Description of Artificial Sequence: Synthetic oligonucleotide
gctgaggatgttggggtttattactgcdtscaggcactcsrmactcctwggacttttggcggagggaccaag

SEQ ID NO: 1824 - DNA, 72 bp, Artificial Sequence
  Description of Artificial Sequence: Synthetic oligonucleotide
gctgaggatgttggggtttattactgcdtscaggcactccagvbccctwggacttttggcggagggaccaag

SEQ ID NO: 1825 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctwggacttttggcggagggaccaag

SEQ ID NO: 1826 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctwggacttttggcggagggaccaag

SEQ ID NO: 1827 - DNA, 72 bp, Artificial Sequence
  Description of Artificial Sequence: Synthetic oligonucleotide
gctgaggatgttggggtttattactgcatgswmgcactcsrmactcctwggacttttggcggagggaccaag

SEQ ID NO: 1828 - DNA, 72 bp, Artificial Sequence
  Description of Artificial Sequence: Synthetic oligonucleotide
gctgaggatgttggggtttattactgcatgswmgcactccagvbccctwggacttttggcggagggaccaag

SEQ ID NO: 1829 - DNA, 72 bp, Artificial Sequence
  Description of Artificial Sequence: Synthetic oligonucleotide
gctgaggatgttggggtttattactgcdtsswmgcactccagactcctcctacttttggcggagggaccaag

SEQ ID NO: 1830 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctcctacttttggcggagggaccaag

SEQ ID NO: 1831 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctcctacttttggcggagggaccaag

SEQ ID NO: 1832 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctcctacttttggcggagggaccaag

SEQ ID NO: 1833 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctcctacttttggcggagggaccaag

SEQ ID NO: 1834 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctcctacttttggcggagggaccaag

SEQ ID NO: 1835 - DNA, 72 bp, Artificial Sequence
  Description of Artificial Sequence: Synthetic oligonucleotide
gctgaggatgttggggtttattactgcatgcaggcactcsrmvbccctcctacttttggcggagggaccaag

SEQ ID NO: 1836 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctcctacttttggcggagggaccaag

SEQ ID NO: 1837 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctcctacttttggcggagggaccaag

SEQ ID NO: 1838 - DNA, 72 bp, Artificial Sequence
  Description of Artificial Sequence: Synthetic oligonucleotide
gctgaggatgttggggtttattactgcdtscaggcactcsrmactcctcctacttttggcggagggaccaag

SEQ ID NO: 1839 - DNA, 72 bp, Artificial Sequence
  Description of Artificial Sequence: Synthetic oligonucleotide
gctgaggatgttggggtttattactgcdtscaggcactccagvbccctcctacttttggcggagggaccaag

SEQ ID NO: 1840 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctcctacttttggcggagggaccaag

SEQ ID NO: 1841 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctcctacttttggcggagggaccaag

SEQ ID NO: 1842 - DNA, 72 bp, Artificial Sequence
  Description of Artificial Sequence: Synthetic oligonucleotide
gctgaggatgttggggtttattactgcatgswmgcactcsrmactcctcctacttttggcggagggaccaag

SEQ ID NO: 1843 - DNA, 72 bp, Artificial Sequence
  Description of Artificial Sequence: Synthetic oligonucleotide
gctgaggatgttggggtttattactgcatgswmgcactccagvbccctcctacttttggcggagggaccaag

SEQ ID NO: 1844 - DNA, 72 bp, Artificial Sequence
  Description of Artificial Sequence: Synthetic oligonucleotide
cctgaagattttgcagtttattactgtswmswmagaagtaattggccttwcacttttggcggagggaccaag

SEQ ID NO: 1845 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggccttwcacttttggcggagggaccaag

SEQ ID NO: 1846 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggccttwcacttttggcggagggaccaag

SEQ ID NO: 1847 - DNA, 72 bp, Artificial Sequence
  Description of Artificial Sequence: Synthetic oligonucleotide
cctgaagattttgcagtttattactgtcagcagbhcagtaatywcccttwcacttttggcggagggaccaag

SEQ ID NO: 1848 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggccttwcacttttggcggagggaccaag

SEQ ID NO: 1849 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywcccttwcacttttggcggagggaccaag

SEQ ID NO: 1850 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywcccttwcacttttggcggagggaccaag

SEQ ID NO: 1851 - DNA, 72 bp, Artificial Sequence
  Description of Artificial Sequence: Synthetic oligonucleotide
cctgaagattttgcagtttattactgtswmcagbhcagtaattggccttwcacttttggcggagggaccaag

SEQ ID NO: 1852 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggccttwcacttttggcggagggaccaag

SEQ ID NO: 1853 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggccttwcacttttggcggagggaccaag

SEQ ID NO: 1854 - DNA, 72 bp, Artificial Sequence
  Description of Artificial Sequence: Synthetic oligonucleotide
cctgaagattttgcagtttattactgtswmcagagaagtaatywcccttwcacttttggcggagggaccaag

SEQ ID NO: 1855 - DNA, 72 bp, Artificial Sequence
  Description of Artificial Sequence: Synthetic oligonucleotide
cctgaagattttgcagtttattactgtcagswmbhcagtaattggccttwcacttttggcggagggaccaag

SEQ ID NO: 1856 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggccttwcacttttggcggagggaccaag

SEQ ID NO: 1857 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggccttwcacttttggcggagggaccaag

SEQ ID NO: 1858 - DNA, 72 bp, Artificial Sequence
  Description of Artificial Sequence: Synthetic oligonucleotide
cctgaagattttgcagtttattactgtcagswmagaagtaatywcccttwcacttttggcggagggaccaag

SEQ ID NO: 1859 - DNA, 72 bp, Artificial Sequence
  Description of Artificial Sequence: Synthetic oligonucleotide
cctgaagattttgcagtttattactgtswmswmagaagtaattggcctmtcacttttggcggagggaccaag

SEQ ID NO: 1860 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctmtcacttttggcggagggaccaag

SEQ ID NO: 1861 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctmtcacttttggcggagggaccaag

SEQ ID NO: 1862 - DNA, 72 bp, Artificial Sequence
  Description of Artificial Sequence: Synthetic oligonucleotide
cctgaagattttgcagtttattactgtcagcagbhcagtaatywccctmtcacttttggcggagggaccaag

SEQ ID NO: 1863 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctmtcacttttggcggagggaccaag

SEQ ID NO: 1864 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctmtcacttttggcggagggaccaag

SEQ ID NO: 1865 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctmtcacttttggcggagggaccaag

SEQ ID NO: 1866 - DNA, 72 bp, Artificial Sequence
  Description of Artificial Sequence: Synthetic oligonucleotide
cctgaagattttgcagtttattactgtswmcagbhcagtaattggcctmtcacttttggcggagggaccaag

SEQ ID NO: 1867 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctmtcacttttggcggagggaccaag

SEQ ID NO: 1868 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctmtcacttttggcggagggaccaag

SEQ ID NO: 1869 - DNA, 72 bp, Artificial Sequence
  Description of Artificial Sequence: Synthetic oligonucleotide
cctgaagattttgcagtttattactgtswmcagagaagtaatywccctmtcacttttggcggagggaccaag

SEQ ID NO: 1870 - DNA, 72 bp, Artificial Sequence
  Description of Artificial Sequence: Synthetic oligonucleotide
cctgaagattttgcagtttattactgtcagswmbhcagtaattggcctmtcacttttggcggagggaccaag

SEQ ID NO: 1871 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctmtcacttttggcggagggaccaag

SEQ ID NO: 1872 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctmtcacttttggcggagggaccaag

SEQ ID NO: 1873 - DNA, 72 bp, Artificial Sequence
  Description of Artificial Sequence: Synthetic oligonucleotide
cctgaagattttgcagtttattactgtcagswmagaagtaatywccctmtcacttttggcggagggaccaag

SEQ ID NO: 1874 - DNA, 72 bp, Artificial Sequence
  Description of Artificial Sequence: Synthetic oligonucleotide
cctgaagattttgcagtttattactgtswmswmagaagtaattggcctwggacttttggcggagggaccaag

SEQ ID NO: 1875 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctwggacttttggcggagggaccaag

SEQ ID NO: 1876 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctwggacttttggcggagggaccaag

SEQ ID NO: 1877 - DNA, 72 bp, Artificial Sequence
  Description of Artificial Sequence: Synthetic oligonucleotide
cctgaagattttgcagtttattactgtcagcagbhcagtaatywccctwggacttttggcggagggaccaag

SEQ ID NO: 1878 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctwggacttttggcggagggaccaag

SEQ ID NO: 1879 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctwggacttttggcggagggaccaag

SEQ ID NO: 1880 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctwggacttttggcggagggaccaag

SEQ ID NO: 1881 - DNA, 72 bp, Artificial Sequence
  Description of Artificial Sequence: Synthetic oligonucleotide
cctgaagattttgcagtttattactgtswmcagbhcagtaattggcctwggacttttggcggagggaccaag

SEQ ID NO: 1882 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctwggacttttggcggagggaccaag

SEQ ID NO: 1883 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctwggacttttggcggagggaccaag

SEQ ID NO: 1884 - DNA, 72 bp, Artificial Sequence
  Description of Artificial Sequence: Synthetic oligonucleotide
cctgaagattttgcagtttattactgtswmcagagaagtaatywccctwggacttttggcggagggaccaag

SEQ ID NO: 1885 - DNA, 72 bp, Artificial Sequence
  Description of Artificial Sequence: Synthetic oligonucleotide
cctgaagattttgcagtttattactgtcagswmbhcagtaattggcctwggacttttggcggagggaccaag

SEQ ID NO: 1886 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctwggacttttggcggagggaccaag

SEQ ID NO: 1887 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctwggacttttggcggagggaccaag

SEQ ID NO: 1888 - DNA, 72 bp, Artificial Sequence
  Description of Artificial Sequence: Synthetic oligonucleotide
cctgaagattttgcagtttattactgtcagswmagaagtaatywccctwggacttttggcggagggaccaag

SEQ ID NO: 1889 - DNA, 72 bp, Artificial Sequence
  Description of Artificial Sequence: Synthetic oligonucleotide
cctgaagattttgcagtttattactgtswmswmagaagtaattggcctcctacttttggcggagggaccaag

SEQ ID NO: 1890 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctcctacttttggcggagggaccaag

SEQ ID NO: 1891 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctcctacttttggcggagggaccaag

SEQ ID NO: 1892 - DNA, 72 bp, Artificial Sequence
  Description of Artificial Sequence: Synthetic oligonucleotide
cctgaagattttgcagtttattactgtcagcagbhcagtaatywccctcctacttttggcggagggaccaag

SEQ ID NO: 1893 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctcctacttttggcggagggaccaag

SEQ ID NO: 1894 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctcctacttttggcggagggaccaag

SEQ ID NO: 1895 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctcctacttttggcggagggaccaag

SEQ ID NO: 1896 - DNA, 72 bp, Artificial Sequence
  Description of Artificial Sequence: Synthetic oligonucleotide
cctgaagattttgcagtttattactgtswmcagbhcagtaattggcctcctacttttggcggagggaccaag

SEQ ID NO: 1897 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctcctacttttggcggagggaccaag

SEQ ID NO: 1898 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctcctacttttggcggagggaccaag

SEQ ID NO: 1899 - DNA, 72 bp, Artificial Sequence
  Description of Artificial Sequence: Synthetic oligonucleotide
cctgaagattttgcagtttattactgtswmcagagaagtaatywccctcctacttttggcggagggaccaag

SEQ ID NO: 1900 - DNA, 72 bp, Artificial Sequence
  Description of Artificial Sequence: Synthetic oligonucleotide
cctgaagattttgcagtttattactgtcagswmbhcagtaattggcctcctacttttggcggagggaccaag

SEQ ID NO: 1901 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctcctacttttggcggagggaccaag

SEQ ID NO: 1902 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctcctacttttggcggagggaccaag

SEQ ID NO: 1903 - DNA, 72 bp, Artificial Sequence
  Description of Artificial Sequence: Synthetic oligonucleotide
cctgaagattttgcagtttattactgtcagswmagaagtaatywccctcctacttttggcggagggaccaag

SEQ ID NO: 1904 - DNA, 75 bp, Artificial Sequence
  Description of Artificial Sequence: Synthetic oligonucleotide
cagtctgaagattttgcagtttattactgtswmswmtacaataattggccttwcacttttggcggagggaccaag

SEQ ID NO: 1905 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggccttwcacttttggcggagggaccaag

SEQ ID NO: 1906 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggccttwcacttttggcggagggaccaag

SEQ ID NO: 1907 - DNA, 75 bp, Artificial Sequence
  Description of Artificial Sequence: Synthetic oligonucleotide
cagtctgaagattttgcagtttattactgtcagcagbhcaataatywcccttwcacttttggcggagggaccaag

SEQ ID NO: 1908 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggccttwcacttttggcggagggaccaag

SEQ ID NO: 1909 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywcccttwcacttttggcggagggaccaag

SEQ ID NO: 1910 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywcccttwcacttttggcggagggaccaag

SEQ ID NO: 1911 - DNA, 75 bp, Artificial Sequence
  Description of Artificial Sequence: Synthetic oligonucleotide
cagtctgaagattttgcagtttattactgtswmcagbhcaataattggccttwcacttttggcggagggaccaag

SEQ ID NO: 1912 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggccttwcacttttggcggagggaccaag

SEQ ID NO: 1913 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggccttwcacttttggcggagggaccaag

SEQ ID NO: 1914 - DNA, 75 bp, Artificial Sequence
  Description of Artificial Sequence: Synthetic oligonucleotide
cagtctgaagattttgcagtttattactgtswmcagtacaataatywcccttwcacttttggcggagggaccaag

SEQ ID NO: 1915 - DNA, 75 bp, Artificial Sequence
  Description of Artificial Sequence: Synthetic oligonucleotide
cagtctgaagattttgcagtttattactgtcagswmbhcaataattggccttwcacttttggcggagggaccaag

SEQ ID NO: 1916 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggccttwcacttttggcggagggaccaag

SEQ ID NO: 1917 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggccttwcacttttggcggagggaccaag

SEQ ID NO: 1918 - DNA, 75 bp, Artificial Sequence
  Description of Artificial Sequence: Synthetic oligonucleotide
cagtctgaagattttgcagtttattactgtcagswmtacaataatywcccttwcacttttggcggagggaccaag

SEQ ID NO: 1919 - DNA, 75 bp, Artificial Sequence
  Description of Artificial Sequence: Synthetic oligonucleotide
cagtctgaagattttgcagtttattactgtswmswmtacaataattggcctmtcacttttggcggagggaccaag

SEQ ID NO: 1920 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctmtcacttttggcggagggaccaag

SEQ ID NO: 1921 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctmtcacttttggcggagggaccaag

SEQ ID NO: 1922 - DNA, 75 bp, Artificial Sequence
  Description of Artificial Sequence: Synthetic oligonucleotide
cagtctgaagattttgcagtttattactgtcagcagbhcaataatywccctmtcacttttggcggagggaccaag

SEQ ID NO: 1923 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctmtcacttttggcggagggaccaag

SEQ ID NO: 1924 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctmtcacttttggcggagggaccaag

SEQ ID NO: 1925 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctmtcacttttggcggagggaccaag

SEQ ID NO: 1926 - DNA, 75 bp, Artificial Sequence
  Description of Artificial Sequence: Synthetic oligonucleotide
cagtctgaagattttgcagtttattactgtswmcagbhcaataattggcctmtcacttttggcggagggaccaag

SEQ ID NO: 1927 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctmtcacttttggcggagggaccaag

SEQ ID NO: 1928 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctmtcacttttggcggagggaccaag

SEQ ID NO: 1929 - DNA, 75 bp, Artificial Sequence
  Description of Artificial Sequence: Synthetic oligonucleotide
cagtctgaagattttgcagtttattactgtswmcagtacaataatywccctmtcacttttggcggagggaccaag

SEQ ID NO: 1930 - DNA, 75 bp, Artificial Sequence
  Description of Artificial Sequence: Synthetic oligonucleotide
cagtctgaagattttgcagtttattactgtcagswmbhcaataattggcctmtcacttttggcggagggaccaag

SEQ ID NO: 1931 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctmtcacttttggcggagggaccaag

SEQ ID NO: 1932 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctmtcacttttggcggagggaccaag

SEQ ID NO: 1933 - DNA, 75 bp, Artificial Sequence
  Description of Artificial Sequence: Synthetic oligonucleotide
cagtctgaagattttgcagtttattactgtcagswmtacaataatywccctmtcacttttggcggagggaccaag

SEQ ID NO: 1934 - DNA, 75 bp, Artificial Sequence
  Description of Artificial Sequence: Synthetic oligonucleotide
cagtctgaagattttgcagtttattactgtswmswmtacaataattggcctwggacttttggcggagggaccaag

SEQ ID NO: 1935 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctwggacttttggcggagggaccaag

SEQ ID NO: 1936 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctwggacttttggcggagggaccaag

SEQ ID NO: 1937 - DNA, 75 bp, Artificial Sequence
  Description of Artificial Sequence: Synthetic oligonucleotide
cagtctgaagattttgcagtttattactgtcagcagbhcaataatywccctwggacttttggcggagggaccaag

SEQ ID NO: 1938 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctwggacttttggcggagggaccaag

SEQ ID NO: 1939 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctwggacttttggcggagggaccaag

SEQ ID NO: 1940 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctwggacttttggcggagggaccaag

SEQ ID NO: 1941 - DNA, 75 bp, Artificial Sequence
  Description of Artificial Sequence: Synthetic oligonucleotide
cagtctgaagattttgcagtttattactgtswmcagbhcaataattggcctwggacttttggcggagggaccaag

SEQ ID NO: 1942 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctwggacttttggcggagggaccaag

SEQ ID NO: 1943 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctwggacttttggcggagggaccaag

SEQ ID NO: 1944 - DNA, 75 bp, Artificial Sequence
  Description of Artificial Sequence: Synthetic oligonucleotide
cagtctgaagattttgcagtttattactgtswmcagtacaataatywccctwggacttttggcggagggaccaag

SEQ ID NO: 1945 - DNA, 75 bp, Artificial Sequence
  Description of Artificial Sequence: Synthetic oligonucleotide
cagtctgaagattttgcagtttattactgtcagswmbhcaataattggcctwggacttttggcggagggaccaag

SEQ ID NO: 1946 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctwggacttttggcggagggaccaag

SEQ ID NO: 1947 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctwggacttttggcggagggaccaag

SEQ ID NO: 1948 - DNA, 75 bp, Artificial Sequence
  Description of Artificial Sequence: Synthetic oligonucleotide
cagtctgaagattttgcagtttattactgtcagswmtacaataatywccctwggacttttggcggagggaccaag

SEQ ID NO: 1949 - DNA, 75 bp, Artificial Sequence
  Description of Artificial Sequence: Synthetic oligonucleotide
cagtctgaagattttgcagtttattactgtswmswmtacaataattggcctcctacttttggcggagggaccaag

SEQ ID NO: 1950 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctcctacttttggcggagggaccaag

SEQ ID NO: 1951 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctcctacttttggcggagggaccaag

SEQ ID NO: 1952 - DNA, 75 bp, Artificial Sequence
  Description of Artificial Sequence: Synthetic oligonucleotide
cagtctgaagattttgcagtttattactgtcagcagbhcaataatywccctcctacttttggcggagggaccaag

SEQ ID NO: 1953 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctcctacttttggcggagggaccaag

SEQ ID NO: 1954 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctcctacttttggcggagggaccaag

SEQ ID NO: 1955 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctcctacttttggcggagggaccaag

SEQ ID NO: 1956 - DNA, 75 bp, Artificial Sequence
  Description of Artificial Sequence: Synthetic oligonucleotide
cagtctgaagattttgcagtttattactgtswmcagbhcaataattggcctcctacttttggcggagggaccaag

SEQ ID NO: 1957 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctcctacttttggcggagggaccaag

SEQ ID NO: 1958 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctcctacttttggcggagggaccaag

SEQ ID NO: 1959 - DNA, 75 bp, Artificial Sequence
  Description of Artificial Sequence: Synthetic oligonucleotide
cagtctgaagattttgcagtttattactgtswmcagtacaataatywccctcctacttttggcggagggaccaag

SEQ ID NO: 1960 - DNA, 75 bp, Artificial Sequence
  Description of Artificial Sequence: Synthetic oligonucleotide
cagtctgaagattttgcagtttattactgtcagswmbhcaataattggcctcctacttttggcggagggaccaag

SEQ ID NO: 1961 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctcctacttttggcggagggaccaag

SEQ ID NO: 1962 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctcctacttttggcggagggaccaag

SEQ ID NO: 1963 - DNA, 75 bp, Artificial Sequence
  Description of Artificial Sequence: Synthetic oligonucleotide
cagtctgaagattttgcagtttattactgtcagswmtacaataatywccctcctacttttggcggagggaccaag

SEQ ID NO: 1964 - DNA, 72 bp, Artificial Sequence
  Description of Artificial Sequence: Synthetic oligonucleotide
cctgaagattttgcagtgtattactgtswmswmtacggaagtagtccttwcacttttggcggagggaccaag

SEQ ID NO: 1965 - DNA, 72 bp, Artificial Sequence
  Description of Artificial Sequence: Synthetic oligonucleotide
cctgaagattttgcagtgtattactgtcagcagbhcbhcagtagtccttwcacttttggcggagggaccaag

SEQ ID NO: 1966 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtccttwcacttttggcggagggaccaag

SEQ ID NO: 1967 - DNA, 72 bp, Artificial Sequence
  Description of Artificial Sequence: Synthetic oligonucleotide
cctgaagattttgcagtgtattactgtcagcagbhcggaagtbhcccttwcacttttggcggagggaccaag

SEQ ID NO: 1968 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtccttwcacttttggcggagggaccaag

SEQ ID NO: 1969 - DNA, 72 bp, Artificial Sequence
  Description of Artificial Sequence: Synthetic oligonucleotide
cctgaagattttgcagtgtattactgtcagcagtacbhcagtbhcccttwcacttttggcggagggaccaag

SEQ ID NO: 1970 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhcccttwcacttttggcggagggaccaag

SEQ ID NO: 1971 - DNA, 72 bp, Artificial Sequence
  Description of Artificial Sequence: Synthetic oligonucleotide
cctgaagattttgcagtgtattactgtswmcagbhcggaagtagtccttwcacttttggcggagggaccaag

SEQ ID NO: 1972 - DNA, 72 bp, Artificial Sequence
  Description of Artificial Sequence: Synthetic oligonucleotide
cctgaagattttgcagtgtattactgtswmcagtacbhcagtagtccttwcacttttggcggagggaccaag

SEQ ID NO: 1973 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtccttwcacttttggcggagggaccaag

SEQ ID NO: 1974 - DNA, 72 bp, Artificial Sequence
  Description of Artificial Sequence: Synthetic oligonucleotide
cctgaagattttgcagtgtattactgtswmcagtacggaagtbhcccttwcacttttggcggagggaccaag

SEQ ID NO: 1975 - DNA, 72 bp, Artificial Sequence
  Description of Artificial Sequence: Synthetic oligonucleotide
cctgaagattttgcagtgtattactgtcagswmbhcggaagtagtccttwcacttttggcggagggaccaag

SEQ ID NO: 1976 - DNA, 72 bp, Artificial Sequence
  Description of Artificial Sequence: Synthetic oligonucleotide
cctgaagattttgcagtgtattactgtcagswmtacbhcagtagtccttwcacttttggcggagggaccaag

SEQ ID NO: 1977 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtccttwcacttttggcggagggaccaag

SEQ ID NO: 1978 - DNA, 72 bp, Artificial Sequence
  Description of Artificial Sequence: Synthetic oligonucleotide
cctgaagattttgcagtgtattactgtcagswmtacggaagtbhcccttwcacttttggcggagggaccaag

SEQ ID NO: 1979 - DNA, 72 bp, Artificial Sequence
  Description of Artificial Sequence: Synthetic oligonucleotide
cctgaagattttgcagtgtattactgtswmswmtacggaagtagtcctmtcacttttggcggagggaccaag

SEQ ID NO: 1980 - DNA, 72 bp, Artificial Sequence
  Description of Artificial Sequence: Synthetic oligonucleotide
cctgaagattttgcagtgtattactgtcagcagbhcbhcagtagtcctmtcacttttggcggagggaccaag

SEQ ID NO: 1981 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctmtcacttttggcggagggaccaag

SEQ ID NO: 1982 - DNA, 72 bp, Artificial Sequence
  Description of Artificial Sequence: Synthetic oligonucleotide
cctgaagattttgcagtgtattactgtcagcagbhcggaagtbhccctmtcacttttggcggagggaccaag

SEQ ID NO: 1983 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctmtcacttttggcggagggaccaag

SEQ ID NO: 1984 - DNA, 72 bp, Artificial Sequence
  Description of Artificial Sequence: Synthetic oligonucleotide
cctgaagattttgcagtgtattactgtcagcagtacbhcagtbhccctmtcacttttggcggagggaccaag

SEQ ID NO: 1985 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctmtcacttttggcggagggaccaag

SEQ ID NO: 1986 - DNA, 72 bp, Artificial Sequence
  Description of Artificial Sequence: Synthetic oligonucleotide
cctgaagattttgcagtgtattactgtswmcagbhcggaagtagtcctmtcacttttggcggagggaccaag

SEQ ID NO: 1987 - DNA, 72 bp, Artificial Sequence
  Description of Artificial Sequence: Synthetic oligonucleotide
cctgaagattttgcagtgtattactgtswmcagtacbhcagtagtcctmtcacttttggcggagggaccaag

SEQ ID NO: 1988 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctmtcacttttggcggagggaccaag

SEQ ID NO: 1989 - DNA, 72 bp, Artificial Sequence
  Description of Artificial Sequence: Synthetic oligonucleotide
cctgaagattttgcagtgtattactgtswmcagtacggaagtbhccctmtcacttttggcggagggaccaag

SEQ ID NO: 1990 - DNA, 72 bp, Artificial Sequence
  Description of Artificial Sequence: Synthetic oligonucleotide
cctgaagattttgcagtgtattactgtcagswmbhcggaagtagtcctmtcacttttggcggagggaccaag

SEQ ID NO: 1991 - DNA, 72 bp, Artificial Sequence
  Description of Artificial Sequence: Synthetic oligonucleotide
cctgaagattttgcagtgtattactgtcagswmtacbhcagtagtcctmtcacttttggcggagggaccaag

SEQ ID NO: 1992 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctmtcacttttggcggagggaccaag

SEQ ID NO: 1993 - DNA, 72 bp, Artificial Sequence
  Description of Artificial Sequence: Synthetic oligonucleotide
cctgaagattttgcagtgtattactgtcagswmtacggaagtbhccctmtcacttttggcggagggaccaag

SEQ ID NO: 1994 - DNA, 72 bp, Artificial Sequence
  Description of Artificial Sequence: Synthetic oligonucleotide
cctgaagattttgcagtgtattactgtswmswmtacggaagtagtcctwggacttttggcggagggaccaag

SEQ ID NO: 1995 - DNA, 72 bp, Artificial Sequence
  Description of Artificial Sequence: Synthetic oligonucleotide
cctgaagattttgcagtgtattactgtcagcagbhcbhcagtagtcctwggacttttggcggagggaccaag

SEQ ID NO: 1996 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctwggacttttggcggagggaccaag

SEQ ID NO: 1997 - DNA, 72 bp, Artificial Sequence
  Description of Artificial Sequence: Synthetic oligonucleotide
cctgaagattttgcagtgtattactgtcagcagbhcggaagtbhccctwggacttttggcggagggaccaag

SEQ ID NO: 1998 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctwggacttttggcggagggaccaag

SEQ ID NO: 1999 - DNA, 72 bp, Artificial Sequence
  Description of Artificial Sequence: Synthetic oligonucleotide
cctgaagattttgcagtgtattactgtcagcagtacbhcagtbhccctwggacttttggcggagggaccaag

SEQ ID NO: 2000 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctwggacttttggcggagggaccaag

SEQ ID NO: 2001 - DNA, 72 bp, Artificial Sequence
  Description of Artificial Sequence: Synthetic oligonucleotide
cctgaagattttgcagtgtattactgtswmcagbhcggaagtagtcctwggacttttggcggagggaccaag

SEQ ID NO: 2002 - DNA, 72 bp, Artificial Sequence
  Description of Artificial Sequence: Synthetic oligonucleotide
cctgaagattttgcagtgtattactgtswmcagtacbhcagtagtcctwggacttttggcggagggaccaag

SEQ ID NO: 2003 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctwggacttttggcggagggaccaag

SEQ ID NO: 2004 - DNA, 72 bp, Artificial Sequence
  Description of Artificial Sequence: Synthetic oligonucleotide
cctgaagattttgcagtgtattactgtswmcagtacggaagtbhccctwggacttttggcggagggaccaag

SEQ ID NO: 2005 - DNA, 72 bp, Artificial Sequence
  Description of Artificial Sequence: Synthetic oligonucleotide
cctgaagattttgcagtgtattactgtcagswmbhcggaagtagtcctwggacttttggcggagggaccaag

SEQ ID NO: 2006 - DNA, 72 bp, Artificial Sequence
  Description of Artificial Sequence: Synthetic oligonucleotide
cctgaagattttgcagtgtattactgtcagswmtacbhcagtagtcctwggacttttggcggagggaccaag

SEQ ID NO: 2007 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctwggacttttggcggagggaccaag

SEQ ID NO: 2008 - DNA, 72 bp, Artificial Sequence
  Description of Artificial Sequence: Synthetic oligonucleotide
cctgaagattttgcagtgtattactgtcagswmtacggaagtbhccctwggacttttggcggagggaccaag

SEQ ID NO: 2009 - DNA, 72 bp, Artificial Sequence
  Description of Artificial Sequence: Synthetic oligonucleotide
cctgaagattttgcagtgtattactgtswmswmtacggaagtagtcctcctacttttggcggagggaccaag

SEQ ID NO: 2010 - DNA, 72 bp, Artificial Sequence
  Description of Artificial Sequence: Synthetic oligonucleotide
cctgaagattttgcagtgtattactgtcagcagbhcbhcagtagtcctcctacttttggcggagggaccaag

SEQ ID NO: 2011 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctcctacttttggcggagggaccaag

SEQ ID NO: 2012 - DNA, 72 bp, Artificial Sequence
  Description of Artificial Sequence: Synthetic oligonucleotide
cctgaagattttgcagtgtattactgtcagcagbhcggaagtbhccctcctacttttggcggagggaccaag

SEQ ID NO: 2013 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctcctacttttggcggagggaccaag

SEQ ID NO: 2014 - DNA, 72 bp, Artificial Sequence
  Description of Artificial Sequence: Synthetic oligonucleotide
cctgaagattttgcagtgtattactgtcagcagtacbhcagtbhccctcctacttttggcggagggaccaag

SEQ ID NO: 2015 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctcctacttttggcggagggaccaag

SEQ ID NO: 2016 - DNA, 72 bp, Artificial Sequence
  Description of Artificial Sequence: Synthetic oligonucleotide
cctgaagattttgcagtgtattactgtswmcagbhcggaagtagtcctcctacttttggcggagggaccaag

SEQ ID NO: 2017 - DNA, 72 bp, Artificial Sequence
  Description of Artificial Sequence: Synthetic oligonucleotide
cctgaagattttgcagtgtattactgtswmcagtacbhcagtagtcctcctacttttggcggagggaccaag

SEQ ID NO: 2018 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctcctacttttggcggagggaccaag

SEQ ID NO: 2019 - DNA, 72 bp, Artificial Sequence
  Description of Artificial Sequence: Synthetic oligonucleotide
cctgaagattttgcagtgtattactgtswmcagtacggaagtbhccctcctacttttggcggagggaccaag

SEQ ID NO: 2020 - DNA, 72 bp, Artificial Sequence
  Description of Artificial Sequence: Synthetic oligonucleotide
cctgaagattttgcagtgtattactgtcagswmbhcggaagtagtcctcctacttttggcggagggaccaag

SEQ ID NO: 2021 - DNA, 72 bp, Artificial Sequence
  Description of Artificial Sequence: Synthetic oligonucleotide
cctgaagattttgcagtgtattactgtcagswmtacbhcagtagtcctcctacttttggcggagggaccaag

SEQ ID NO: 2022 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctcctacttttggcggagggaccaag

SEQ ID NO: 2023 - DNA, 72 bp, Artificial Sequence
  Description of Artificial Sequence: Synthetic oligonucleotide
cctgaagattttgcagtgtattactgtcagswmtacggaagtbhccctcctacttttggcggagggaccaag

SEQ ID NO: 2024 - DNA, 72 bp, Artificial Sequence
  Description of Artificial Sequence: Synthetic oligonucleotide
cctgatgattttgcaacttattactgccagcagbhcvrmmbctacycttwcacttttggcggagggaccaag

SEQ ID NO: 2025 - DNA, 72 bp, Artificial Sequence
  Description of Artificial Sequence: Synthetic oligonucleotide
cctgatgattttgcaacttattactgccagcagbhcvrmmbctacyctmtcacttttggcggagggaccaag

SEQ ID NO: 2026 - DNA, 72 bp, Artificial Sequence
  Description of Artificial Sequence: Synthetic oligonucleotide
cctgatgattttgcaacttattactgccagcagbhcvrmmbctacyctwggacttttggcggagggaccaag

SEQ ID NO: 2027 - DNA, 72 bp, Artificial Sequence
  Description of Artificial Sequence: Synthetic oligonucleotide
cctgatgattttgcaacttattactgccagcagbhcvrmmbctacyctcctacttttggcggagggaccaag

SEQ ID NO: 2028 - DNA, 72 bp, Artificial Sequence
  Description of Artificial Sequence: Synthetic oligonucleotide
cctgatgattttgcaacttattactgccagcagbhcaatmbcywcycttwcacttttggcggagggaccaag

SEQ ID NO: 2029 - DNA, 72 bp, Artificial Sequence
  Description of Artificial Sequence: Synthetic oligonucleotide
cctgatgattttgcaacttattactgccagcagbhcaatmbcywcyctmtcacttttggcggagggaccaag

SEQ ID NO: 2030 - DNA, 72 bp, Artificial Sequence
  Description of Artificial Sequence: Synthetic oligonucleotide
cctgatgattttgcaacttattactgccagcagbhcaatmbcywcyctwggacttttggcggagggaccaag

SEQ ID NO: 2031 - DNA, 72 bp, Artificial Sequence
  Description of Artificial Sequence: Synthetic oligonucleotide
cctgatgattttgcaacttattactgccagcagbhcaatmbcywcyctcctacttttggcggagggaccaag

SEQ ID NO: 2032 - DNA, 72 bp, Artificial Sequence
  Description of Artificial Sequence: Synthetic oligonucleotide
cctgatgattttgcaacttattactgccagcagbhcvrmagtywcycttwcacttttggcggagggaccaag

SEQ ID NO: 2033 - DNA, 72 bp, Artificial Sequence
  Description of Artificial Sequence: Synthetic oligonucleotide
cctgatgattttgcaacttattactgccagcagbhcvrmagtywcyctmtcacttttggcggagggaccaag

SEQ ID NO: 2034 - DNA, 72 bp, Artificial Sequence
  Description of Artificial Sequence: Synthetic oligonucleotide
cctgatgattttgcaacttattactgccagcagbhcvrmagtywcyctwggacttttggcggagggaccaag

SEQ ID NO: 2035 - DNA, 72 bp, Artificial Sequence
  Description of Artificial Sequence: Synthetic oligonucleotide
cctgatgattttgcaacttattactgccagcagbhcvrmagtywcyctcctacttttggcggagggaccaag

SEQ ID NO: 2036 - DNA, 72 bp, Artificial Sequence
  Description of Artificial Sequence: Synthetic oligonucleotide
cctgatgattttgcaacttattactgccagcagtacvrmmbcywcycttwcacttttggcggagggaccaag

SEQ ID NO: 2037 - DNA, 72 bp, Artificial Sequence
  Description of Artificial Sequence: Synthetic oligonucleotide
cctgatgattttgcaacttattactgccagcagtacvrmmbcywcyctmtcacttttggcggagggaccaag

SEQ ID NO: 2038 - DNA, 72 bp, Artificial Sequence
  Description of Artificial Sequence: Synthetic oligonucleotide
cctgatgattttgcaacttattactgccagcagtacvrmmbcywcyctwggacttttggcggagggaccaag

SEQ ID NO: 2039 - DNA, 72 bp, Artificial Sequence
  Description of Artificial Sequence: Synthetic oligonucleotide
cctgatgattttgcaacttattactgccagcagtacvrmmbcywcyctcctacttttggcggagggaccaag

SEQ ID NO: 2040 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttcccttwcacttttggcggagggaccaag

SEQ ID NO: 2041 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctmtcacttttggcggagggaccaag

SEQ ID NO: 2042 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctwggacttttggcggagggaccaag

SEQ ID NO: 2043 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctcctacttttggcggagggaccaag

SEQ ID NO: 2044 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywcccttwcacttttggcggagggaccaag

SEQ ID NO: 2045 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctmtcacttttggcggagggaccaag

SEQ ID NO: 2046 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctwggacttttggcggagggaccaag

SEQ ID NO: 2047 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctcctacttttggcggagggaccaag

SEQ ID NO: 2048 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywcccttwcacttttggcggagggaccaag

SEQ ID NO: 2049 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctmtcacttttggcggagggaccaag

SEQ ID NO: 2050 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctwggacttttggcggagggaccaag

SEQ ID NO: 2051 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctcctacttttggcggagggaccaag

SEQ ID NO: 2052 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywcccttwcacttttggcggagggaccaag

SEQ ID NO: 2053 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctmtcacttttggcggagggaccaag

SEQ ID NO: 2054 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctwggacttttggcggagggaccaag

SEQ ID NO: 2055 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctcctacttttggcggagggaccaag

SEQ ID NO: 2056 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctcccttwcacttttggcggagggaccaag

SEQ ID NO: 2057 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctmtcacttttggcggagggaccaag

SEQ ID NO: 2058 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctwggacttttggcggagggaccaag

SEQ ID NO: 2059 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctcctacttttggcggagggaccaag

SEQ ID NO: 2060 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywcccttwcacttttggcggagggaccaag

SEQ ID NO: 2061 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctmtcacttttggcggagggaccaag

SEQ ID NO: 2062 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctwggacttttggcggagggaccaag

SEQ ID NO: 2063 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctcctacttttggcggagggaccaag

SEQ ID NO: 2064 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywcccttwcacttttggcggagggaccaag

SEQ ID NO: 2065 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctmtcacttttggcggagggaccaag

SEQ ID NO: 2066 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctwggacttttggcggagggaccaag

SEQ ID NO: 2067 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctcctacttttggcggagggaccaag

SEQ ID NO: 2068 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywcccttwcacttttggcggagggaccaag

SEQ ID NO: 2069 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctmtcacttttggcggagggaccaag

SEQ ID NO: 2070 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctwggacttttggcggagggaccaag

SEQ ID NO: 2071 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctcctacttttggcggagggaccaag

SEQ ID NO: 2072 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactccttwcacttttggcggagggaccaag

SEQ ID NO: 2073 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctmtcacttttggcggagggaccaag

SEQ ID NO: 2074 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctwggacttttggcggagggaccaag

SEQ ID NO: 2075 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctcctacttttggcggagggaccaag

SEQ ID NO: 2076 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhcccttwcacttttggcggagggaccaag

SEQ ID NO: 2077 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctmtcacttttggcggagggaccaag

SEQ ID NO: 2078 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctwggacttttggcggagggaccaag

SEQ ID NO: 2079 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctcctacttttggcggagggaccaag

SEQ ID NO: 2080 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhcccttwcacttttggcggagggaccaag

SEQ ID NO: 2081 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctmtcacttttggcggagggaccaag

SEQ ID NO: 2082 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctwggacttttggcggagggaccaag

SEQ ID NO: 2083 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctcctacttttggcggagggaccaag

SEQ ID NO: 2084 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhcccttwcacttttggcggagggaccaag

SEQ ID NO: 2085 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctmtcacttttggcggagggaccaag

SEQ ID NO: 2086 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctwggacttttggcggagggaccaag

SEQ ID NO: 2087 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctcctacttttggcggagggaccaag

SEQ ID NO: 2088 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactccttwcacttttggcggagggaccaag

SEQ ID NO: 2089 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctmtcacttttggcggagggaccaag

SEQ ID NO: 2090 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctwggacttttggcggagggaccaag

SEQ ID NO: 2091 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctcctacttttggcggagggaccaag

SEQ ID NO: 2092 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbcccttwcacttttggcggagggaccaag

SEQ ID NO: 2093 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctmtcacttttggcggagggaccaag

SEQ ID NO: 2094 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctwggacttttggcggagggaccaag

SEQ ID NO: 2095 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctcctacttttggcggagggaccaag

SEQ ID NO: 2096 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbcccttwcacttttggcggagggaccaag

SEQ ID NO: 2097 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctmtcacttttggcggagggaccaag

SEQ ID NO: 2098 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctwggacttttggcggagggaccaag

SEQ ID NO: 2099 - DNA, 72 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctcctacttttggcggagggaccaag

SEQ ID NO: 2100 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbcccttwcacttttggcggagggaccaag

SEQ ID NO: 2101 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctmtcacttttggcggagggaccaag

SEQ ID NO: 2102 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctwggacttttggcggagggaccaag

SEQ ID NO: 2103 - DNA, 72 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctcctacttttggcggagggaccaag

SEQ ID NO: 2104 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggccttwcacttttggcggagggaccaag

SEQ ID NO: 2105 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctmtcacttttggcggagggaccaag

SEQ ID NO: 2106 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctwggacttttggcggagggaccaag

SEQ ID NO: 2107 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctcctacttttggcggagggaccaag

SEQ ID NO: 2108 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywcccttwcacttttggcggagggaccaag

SEQ ID NO: 2109 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctmtcacttttggcggagggaccaag

SEQ ID NO: 2110 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctwggacttttggcggagggaccaag

SEQ ID NO: 2111 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctcctacttttggcggagggaccaag

SEQ ID NO: 2112 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywcccttwcacttttggcggagggaccaag

SEQ ID NO: 2113 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctmtcacttttggcggagggaccaag

SEQ ID NO: 2114 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctwggacttttggcggagggaccaag

SEQ ID NO: 2115 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctcctacttttggcggagggaccaag

SEQ ID NO: 2116 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywcccttwcacttttggcggagggaccaag

SEQ ID NO: 2117 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctmtcacttttggcggagggaccaag

SEQ ID NO: 2118 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctwggacttttggcggagggaccaag

SEQ ID NO: 2119 - DNA, 72 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctcctacttttggcggagggaccaag

SEQ ID NO: 2120 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggccttwcacttttggcggagggaccaag

SEQ ID NO: 2121 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctmtcacttttggcggagggaccaag

SEQ ID NO: 2122 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctwggacttttggcggagggaccaag

SEQ ID NO: 2123 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctcctacttttggcggagggaccaag

SEQ ID NO: 2124 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywcccttwcacttttggcggagggaccaag

SEQ ID NO: 2125 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctmtcacttttggcggagggaccaag

SEQ ID NO: 2126 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctwggacttttggcggagggaccaag

SEQ ID NO: 2127 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctcctacttttggcggagggaccaag

SEQ ID NO: 2128 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywcccttwcacttttggcggagggaccaag

SEQ ID NO: 2129 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctmtcacttttggcggagggaccaag

SEQ ID NO: 2130 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctwggacttttggcggagggaccaag

SEQ ID NO: 2131 - DNA, 75 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctcctacttttggcggagggaccaag

SEQ ID NO: 2132 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywcccttwcacttttggcggagggaccaag

SEQ ID NO: 2133 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctmtcacttttggcggagggaccaag

SEQ ID NO: 2134 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctwggacttttggcggagggaccaag

SEQ ID NO: 2135 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctcctacttttggcggagggaccaag

SEQ ID NO: 2136 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtccttwcacttttggcggagggaccaag

SEQ ID NO: 2137 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctmtcacttttggcggagggaccaag

SEQ ID NO: 2138 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctwggacttttggcggagggaccaag

SEQ ID NO: 2139 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctcctacttttggcggagggaccaag

SEQ ID NO: 2140 - DNA, 72 bp, Artificial Sequence
  Description of Artificial Sequence: Synthetic oligonucleotide
cctgaagattttgcagtgtattactgtcagcagbhcbhcagtbhcccttwcacttttggcggagggaccaag

SEQ ID NO: 2141 - DNA, 72 bp, Artificial Sequence
  Description of Artificial Sequence: Synthetic oligonucleotide
cctgaagattttgcagtgtattactgtcagcagbhcbhcagtbhccctmtcacttttggcggagggaccaag

SEQ ID NO: 2142 - DNA, 72 bp, Artificial Sequence
  Description of Artificial Sequence: Synthetic oligonucleotide
cctgaagattttgcagtgtattactgtcagcagbhcbhcagtbhccctwggacttttggcggagggaccaag

SEQ ID NO: 2143 - DNA, 72 bp, Artificial Sequence
  Description of Artificial Sequence: Synthetic oligonucleotide
cctgaagattttgcagtgtattactgtcagcagbhcbhcagtbhccctcctacttttggcggagggaccaag

SEQ ID NO: 2144 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhcccttwcacttttggcggagggaccaag

SEQ ID NO: 2145 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctmtcacttttggcggagggaccaag

SEQ ID NO: 2146 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctwggacttttggcggagggaccaag

SEQ ID NO: 2147 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctcctacttttggcggagggaccaag

SEQ ID NO: 2148 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhcccttwcacttttggcggagggaccaag

SEQ ID NO: 2149 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctmtcacttttggcggagggaccaag

SEQ ID NO: 2150 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctwggacttttggcggagggaccaag

SEQ ID NO: 2151 - DNA, 72 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctcctacttttggcggagggaccaag

SEQ ID NO: 2152 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactccttwcacttttggcggagggaccaag

SEQ ID NO: 2153 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctmtcacttttggcggagggaccaag

SEQ ID NO: 2154 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctwggacttttggcggagggaccaag

SEQ ID NO: 2155 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctcctacttttggcggagggaccaag

SEQ ID NO: 2156 - DNA, 72 bp, Artificial Sequence
  Description of Artificial Sequence: Synthetic oligonucleotide
gctgaagatgtggcagtttattactgtcagcagbhcbhcagtbhcccttwcacttttggcggagggaccaag

SEQ ID NO: 2157 - DNA, 72 bp, Artificial Sequence
  Description of Artificial Sequence: Synthetic oligonucleotide
gctgaagatgtggcagtttattactgtcagcagbhcbhcagtbhccctmtcacttttggcggagggaccaag

SEQ ID NO: 2158 - DNA, 72 bp, Artificial Sequence
  Description of Artificial Sequence: Synthetic oligonucleotide
gctgaagatgtggcagtttattactgtcagcagbhcbhcagtbhccctwggacttttggcggagggaccaag

SEQ ID NO: 2159 - DNA, 72 bp, Artificial Sequence
  Description of Artificial Sequence: Synthetic oligonucleotide
gctgaagatgtggcagtttattactgtcagcagbhcbhcagtbhccctcctacttttggcggagggaccaag

SEQ ID NO: 2160 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhcccttwcacttttggcggagggaccaag

SEQ ID NO: 2161 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctmtcacttttggcggagggaccaag

SEQ ID NO: 2162 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctwggacttttggcggagggaccaag

SEQ ID NO: 2163 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctcctacttttggcggagggaccaag

SEQ ID NO: 2164 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhcccttwcacttttggcggagggaccaag

SEQ ID NO: 2165 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctmtcacttttggcggagggaccaag

SEQ ID NO: 2166 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctwggacttttggcggagggaccaag

SEQ ID NO: 2167 - DNA, 72 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctcctacttttggcggagggaccaag

SEQ ID NO: 2168 - DNA, 27 bp, Artificial Sequence
  Description of Artificial Sequence: Synthetic oligonucleotide
swmswmtacaatagttacycttwcact

SEQ ID NO: 2169 - DNA, 27 bp, Artificial Sequence
  Description of Artificial Sequence: Synthetic oligonucleotide
cagcagbhcvrmagttacycttwcact

SEQ ID NO: 2170 - DNA, 27 bp, Artificial Sequence
  Description of Artificial Sequence: Synthetic oligonucleotide
cagcagbhcaatmbctacycttwcact

SEQ ID NO: 2171 - DNA, 27 bp, Artificial Sequence
  Description of Artificial Sequence: Synthetic oligonucleotide
cagcagbhcaatagtywcycttwcact

SEQ ID NO: 2172 - DNA, 27 bp, Artificial Sequence
  Description of Artificial Sequence: Synthetic oligonucleotide
cagcagtacvrmmbctacycttwcact

SEQ ID NO: 2173 - DNA, 27 bp, Artificial Sequence
  Description of Artificial Sequence: Synthetic oligonucleotide
cagcagtacvrmagtywcycttwcact

SEQ ID NO: 2174 - DNA, 27 bp, Artificial Sequence
  Description of Artificial Sequence: Synthetic oligonucleotide
cagcagtacaatmbcywcycttwcact

SEQ ID NO: 2175 - DNA, 27 bp, Artificial Sequence
  Description of Artificial Sequence: Synthetic oligonucleotide
swmcagbhcaatagttacycttwcact

SEQ ID NO: 2176 - DNA, 27 bp, Artificial Sequence
  Description of Artificial Sequence: Synthetic oligonucleotide
swmcagtacvrmagttacycttwcact

SEQ ID NO: 2177 - DNA, 27 bp, Artificial Sequence
  Description of Artificial Sequence: Synthetic oligonucleotide
swmcagtacaatmbctacycttwcact

SEQ ID NO: 2178 - DNA, 27 bp, Artificial Sequence
  Description of Artificial Sequence: Synthetic oligonucleotide
swmcagtacaatagtywcycttwcact

SEQ ID NO: 2179 - DNA, 27 bp, Artificial Sequence
  Description of Artificial Sequence: Synthetic oligonucleotide
cagswmbhcaatagttacycttwcact

SEQ ID NO: 2180 - DNA, 27 bp, Artificial Sequence
  Description of Artificial Sequence: Synthetic oligonucleotide
cagswmtacvrmagttacycttwcact

SEQ ID NO: 2181 - DNA, 27 bp, Artificial Sequence
  Description of Artificial Sequence: Synthetic oligonucleotide
cagswmtacaatmbctacycttwcact

SEQ ID NO: 2182 - DNA, 27 bp, Artificial Sequence
  Description of Artificial Sequence: Synthetic oligonucleotide
cagswmtacaatagtywcycttwcact

SEQ ID NO: 2183 - DNA, 27 bp, Artificial Sequence
  Description of Artificial Sequence: Synthetic oligonucleotide
swmswmtacaatagttacyctmtcact

SEQ ID NO: 2184 - DNA, 27 bp, Artificial Sequence
  Description of Artificial Sequence: Synthetic oligonucleotide
cagcagbhcvrmagttacyctmtcact

SEQ ID NO: 2185 - DNA, 27 bp, Artificial Sequence
  Description of Artificial Sequence: Synthetic oligonucleotide
cagcagbhcaatmbctacyctmtcact

SEQ ID NO: 2186 - DNA, 27 bp, Artificial Sequence
  Description of Artificial Sequence: Synthetic oligonucleotide
cagcagbhcaatagtywcyctmtcact

SEQ ID NO: 2187 - DNA, 27 bp, Artificial Sequence
  Description of Artificial Sequence: Synthetic oligonucleotide
cagcagtacvrmmbctacyctmtcact

SEQ ID NO: 2188 - DNA, 27 bp, Artificial Sequence
  Description of Artificial Sequence: Synthetic oligonucleotide
cagcagtacvrmagtywcyctmtcact

SEQ ID NO: 2189 - DNA, 27 bp, Artificial Sequence
  Description of Artificial Sequence: Synthetic oligonucleotide
cagcagtacaatmbcywcyctmtcact

SEQ ID NO: 2190 - DNA, 27 bp, Artificial Sequence
  Description of Artificial Sequence: Synthetic oligonucleotide
swmcagbhcaatagttacyctmtcact

SEQ ID NO: 2191 - DNA, 27 bp, Artificial Sequence
  Description of Artificial Sequence: Synthetic oligonucleotide
swmcagtacvrmagttacyctmtcact

SEQ ID NO: 2192 - DNA, 27 bp, Artificial Sequence
  Description of Artificial Sequence: Synthetic oligonucleotide
swmcagtacaatmbctacyctmtcact

SEQ ID NO: 2193 - DNA, 27 bp, Artificial Sequence
  Description of Artificial Sequence: Synthetic oligonucleotide
swmcagtacaatagtywcyctmtcact

SEQ ID NO: 2194 - DNA, 27 bp, Artificial Sequence
  Description of Artificial Sequence: Synthetic oligonucleotide
cagswmbhcaatagttacyctmtcact

SEQ ID NO: 2195 - DNA, 27 bp, Artificial Sequence
  Description of Artificial Sequence: Synthetic oligonucleotide
cagswmtacvrmagttacyctmtcact

SEQ ID NO: 2196 - DNA, 27 bp, Artificial Sequence
  Description of Artificial Sequence: Synthetic oligonucleotide
cagswmtacaatmbctacyctmtcact

SEQ ID NO: 2197 - DNA, 27 bp, Artificial Sequence
  Description of Artificial Sequence: Synthetic oligonucleotide
cagswmtacaatagtywcyctmtcact

SEQ ID NO: 2198 - DNA, 27 bp, Artificial Sequence
  Description of Artificial Sequence: Synthetic oligonucleotide
swmswmtacaatagttacyctwggact

SEQ ID NO: 2199 - DNA, 27 bp, Artificial Sequence
  Description of Artificial Sequence: Synthetic oligonucleotide
cagcagbhcvrmagttacyctwggact

SEQ ID NO: 2200 - DNA, 27 bp, Artificial Sequence
  Description of Artificial Sequence: Synthetic oligonucleotide
cagcagbhcaatmbctacyctwggact

SEQ ID NO: 2201 - DNA, 27 bp, Artificial Sequence
  Description of Artificial Sequence: Synthetic oligonucleotide
cagcagbhcaatagtywcyctwggact

SEQ ID NO: 2202 - DNA, 27 bp, Artificial Sequence
  Description of Artificial Sequence: Synthetic oligonucleotide
cagcagtacvrmmbctacyctwggact

SEQ ID NO: 2203 - DNA, 27 bp, Artificial Sequence
  Description of Artificial Sequence: Synthetic oligonucleotide
cagcagtacvrmagtywcyctwggact

SEQ ID NO: 2204 - DNA, 27 bp, Artificial Sequence
  Description of Artificial Sequence: Synthetic oligonucleotide
cagcagtacaatmbcywcyctwggact

SEQ ID NO: 2205 - DNA, 27 bp, Artificial Sequence
  Description of Artificial Sequence: Synthetic oligonucleotide
swmcagbhcaatagttacyctwggact

SEQ ID NO: 2206 - DNA, 27 bp, Artificial Sequence
  Description of Artificial Sequence: Synthetic oligonucleotide
swmcagtacvrmagttacyctwggact

SEQ ID NO: 2207 - DNA, 27 bp, Artificial Sequence
  Description of Artificial Sequence: Synthetic oligonucleotide
swmcagtacaatmbctacyctwggact

SEQ ID NO: 2208 - DNA, 27 bp, Artificial Sequence
  Description of Artificial Sequence: Synthetic oligonucleotide
swmcagtacaatagtywcyctwggact

SEQ ID NO: 2209 - DNA, 27 bp, Artificial Sequence
  Description of Artificial Sequence: Synthetic oligonucleotide
cagswmbhcaatagttacyctwggact

SEQ ID NO: 2210 - DNA, 27 bp, Artificial Sequence
  Description of Artificial Sequence: Synthetic oligonucleotide
cagswmtacvrmagttacyctwggact

SEQ ID NO: 2211 - DNA, 27 bp, Artificial Sequence
  Description of Artificial Sequence: Synthetic oligonucleotide
cagswmtacaatmbctacyctwggact

SEQ ID NO: 2212 - DNA, 27 bp, Artificial Sequence
  Description of Artificial Sequence: Synthetic oligonucleotide
cagswmtacaatagtywcyctwggact

SEQ ID NO: 2213 - DNA, 27 bp, Artificial Sequence
  Description of Artificial Sequence: Synthetic oligonucleotide
swmswmtacaatagttacyctcctact

SEQ ID NO: 2214 - DNA, 27 bp, Artificial Sequence
  Description of Artificial Sequence: Synthetic oligonucleotide
cagcagbhcvrmagttacyctcctact

SEQ ID NO: 2215 - DNA, 27 bp, Artificial Sequence
  Description of Artificial Sequence: Synthetic oligonucleotide
cagcagbhcaatmbctacyctcctact

SEQ ID NO: 2216 - DNA, 27 bp, Artificial Sequence
  Description of Artificial Sequence: Synthetic oligonucleotide
cagcagbhcaatagtywcyctcctact

SEQ ID NO: 2217 - DNA, 27 bp, Artificial Sequence
  Description of Artificial Sequence: Synthetic oligonucleotide
cagcagtacvrmmbctacyctcctact

SEQ ID NO: 2218 - DNA, 27 bp, Artificial Sequence
  Description of Artificial Sequence: Synthetic oligonucleotide
cagcagtacvrmagtywcyctcctact

SEQ ID NO: 2219 - DNA, 27 bp, Artificial Sequence
  Description of Artificial Sequence: Synthetic oligonucleotide
cagcagtacaatmbcywcyctcctact

SEQ ID NO: 2220 - DNA, 27 bp, Artificial Sequence
  Description of Artificial Sequence: Synthetic oligonucleotide
swmcagbhcaatagttacyctcctact

SEQ ID NO: 2221 - DNA, 27 bp, Artificial Sequence
  Description of Artificial Sequence: Synthetic oligonucleotide
swmcagtacvrmagttacyctcctact

SEQ ID NO: 2222 - DNA, 27 bp, Artificial Sequence
  Description of Artificial Sequence: Synthetic oligonucleotide
swmcagtacaatmbctacyctcctact

SEQ ID NO: 2223 - DNA, 27 bp, Artificial Sequence
  Description of Artificial Sequence: Synthetic oligonucleotide
swmcagtacaatagtywcyctcctact

SEQ ID NO: 2224 - DNA, 27 bp, Artificial Sequence
  Description of Artificial Sequence: Synthetic oligonucleotide
cagswmbhcaatagttacyctcctact

SEQ ID NO: 2225 - DNA, 27 bp, Artificial Sequence
  Description of Artificial Sequence: Synthetic oligonucleotide
cagswmtacvrmagttacyctcctact

SEQ ID NO: 2226 - DNA, 27 bp, Artificial Sequence
  Description of Artificial Sequence: Synthetic oligonucleotide
cagswmtacaatmbctacyctcctact

SEQ ID NO: 2227 - DNA, 27 bp, Artificial Sequence
  Description of Artificial Sequence: Synthetic oligonucleotide
cagswmtacaatagtywcyctcctact

SEQ ID NO: 2228 - DNA, 27 bp, Artificial Sequence
  Description of Artificial Sequence: Synthetic oligonucleotide
swmswmgcaaatagtttcccttwcact

SEQ ID NO: 2229 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttcccttwcact

SEQ ID NO: 2230 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttcccttwcact

SEQ ID NO: 2231 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywcccttwcact

SEQ ID NO: 2232 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttcccttwcact

SEQ ID NO: 2233 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywcccttwcact

SEQ ID NO: 2234 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywcccttwcact

SEQ ID NO: 2235 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttcccttwcact

SEQ ID NO: 2236 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttcccttwcact

SEQ ID NO: 2237 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttcccttwcact

SEQ ID NO: 2238 - DNA, 27 bp, Artificial Sequence
  Description of Artificial Sequence: Synthetic oligonucleotide
swmcaggcaaatagtywcccttwcact

SEQ ID NO: 2239 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttcccttwcact

SEQ ID NO: 2240 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttcccttwcact

SEQ ID NO: 2241 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttcccttwcact

SEQ ID NO: 2242 - DNA, 27 bp, Artificial Sequence
  Description of Artificial Sequence: Synthetic oligonucleotide
cagswmgcaaatagtywcccttwcact

SEQ ID NO: 2243 - DNA, 27 bp, Artificial Sequence
  Description of Artificial Sequence: Synthetic oligonucleotide
swmswmgcaaatagtttccctmtcact

SEQ ID NO: 2244 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctmtcact

SEQ ID NO: 2245 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctmtcact

SEQ ID NO: 2246 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctmtcact

SEQ ID NO: 2247 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctmtcact

SEQ ID NO: 2248 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctmtcact

SEQ ID NO: 2249 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctmtcact

SEQ ID NO: 2250 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctmtcact

SEQ ID NO: 2251 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctmtcact

SEQ ID NO: 2252 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctmtcact

SEQ ID NO: 2253 - DNA, 27 bp, Artificial Sequence
  Description of Artificial Sequence: Synthetic oligonucleotide
swmcaggcaaatagtywccctmtcact

SEQ ID NO: 2254 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctmtcact

SEQ ID NO: 2255 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctmtcact

SEQ ID NO: 2256 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctmtcact

SEQ ID NO: 2257 - DNA, 27 bp, Artificial Sequence
  Description of Artificial Sequence: Synthetic oligonucleotide
cagswmgcaaatagtywccctmtcact

SEQ ID NO: 2258 - DNA, 27 bp, Artificial Sequence
  Description of Artificial Sequence: Synthetic oligonucleotide
swmswmgcaaatagtttccctwggact

SEQ ID NO: 2259 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctwggact

SEQ ID NO: 2260 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctwggact

SEQ ID NO: 2261 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctwggact

SEQ ID NO: 2262 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctwggact

SEQ ID NO: 2263 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctwggact

SEQ ID NO: 2264 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctwggact

SEQ ID NO: 2265 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctwggact

SEQ ID NO: 2266 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctwggact

SEQ ID NO: 2267 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctwggact

SEQ ID NO: 2268 - DNA, 27 bp, Artificial Sequence
  Description of Artificial Sequence: Synthetic oligonucleotide
swmcaggcaaatagtywccctwggact

SEQ ID NO: 2269 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctwggact

SEQ ID NO: 2270 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctwggact

SEQ ID NO: 2271 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctwggact

SEQ ID NO: 2272 - DNA, 27 bp, Artificial Sequence
  Description of Artificial Sequence: Synthetic oligonucleotide
cagswmgcaaatagtywccctwggact

SEQ ID NO: 2273 - DNA, 27 bp, Artificial Sequence
  Description of Artificial Sequence: Synthetic oligonucleotide
swmswmgcaaatagtttccctcctact

SEQ ID NO: 2274 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctcctact

SEQ ID NO: 2275 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctcctact

SEQ ID NO: 2276 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctcctact

SEQ ID NO: 2277 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctcctact

SEQ ID NO: 2278 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctcctact

SEQ ID NO: 2279 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctcctact

SEQ ID NO: 2280 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctcctact

SEQ ID NO: 2281 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctcctact

SEQ ID NO: 2282 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctcctact

SEQ ID NO: 2283 - DNA, 27 bp, Artificial Sequence
  Description of Artificial Sequence: Synthetic oligonucleotide
swmcaggcaaatagtywccctcctact

SEQ ID NO: 2284 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctcctact

SEQ ID NO: 2285 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctcctact

SEQ ID NO: 2286 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctcctact

SEQ ID NO: 2287 - DNA, 27 bp, Artificial Sequence
  Description of Artificial Sequence: Synthetic oligonucleotide
cagswmgcaaatagtywccctcctact

SEQ ID NO: 2288 - DNA, 27 bp, Artificial Sequence
  Description of Artificial Sequence: Synthetic oligonucleotide
swmswmtacgataatctcccttwcact

SEQ ID NO: 2289 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctcccttwcact

SEQ ID NO: 2290 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctcccttwcact

SEQ ID NO: 2291 - DNA, 27 bp, Artificial Sequence
  Description of Artificial Sequence: Synthetic oligonucleotide
cagcagbhcgataatywcccttwcact

SEQ ID NO: 2292 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctcccttwcact

SEQ ID NO: 2293 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywcccttwcact

SEQ ID NO: 2294 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywcccttwcact

SEQ ID NO: 2295 - DNA, 27 bp, Artificial Sequence
  Description of Artificial Sequence: Synthetic oligonucleotide
swmcagbhcgataatctcccttwcact

SEQ ID NO: 2296 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctcccttwcact

SEQ ID NO: 2297 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctcccttwcact

SEQ ID NO: 2298 - DNA, 27 bp, Artificial Sequence
  Description of Artificial Sequence: Synthetic oligonucleotide
swmcagtacgataatywcccttwcact

SEQ ID NO: 2299 - DNA, 27 bp, Artificial Sequence
  Description of Artificial Sequence: Synthetic oligonucleotide
cagswmbhcgataatctcccttwcact

SEQ ID NO: 2300 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctcccttwcact

SEQ ID NO: 2301 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctcccttwcact

SEQ ID NO: 2302 - DNA, 27 bp, Artificial Sequence
  Description of Artificial Sequence: Synthetic oligonucleotide
cagswmtacgataatywcccttwcact

SEQ ID NO: 2303 - DNA, 27 bp, Artificial Sequence
  Description of Artificial Sequence: Synthetic oligonucleotide
swmswmtacgataatctccctmtcact

SEQ ID NO: 2304 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctmtcact

SEQ ID NO: 2305 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctmtcact

SEQ ID NO: 2306 - DNA, 27 bp, Artificial Sequence
  Description of Artificial Sequence: Synthetic oligonucleotide
cagcagbhcgataatywccctmtcact

SEQ ID NO: 2307 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctmtcact

SEQ ID NO: 2308 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctmtcact

SEQ ID NO: 2309 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctmtcact

SEQ ID NO: 2310 - DNA, 27 bp, Artificial Sequence
  Description of Artificial Sequence: Synthetic oligonucleotide
swmcagbhcgataatctccctmtcact

SEQ ID NO: 2311 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctmtcact

SEQ ID NO: 2312 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctmtcact

SEQ ID NO: 2313 - DNA, 27 bp, Artificial Sequence
  Description of Artificial Sequence: Synthetic oligonucleotide
swmcagtacgataatywccctmtcact

SEQ ID NO: 2314 - DNA, 27 bp, Artificial Sequence
  Description of Artificial Sequence: Synthetic oligonucleotide
cagswmbhcgataatctccctmtcact

SEQ ID NO: 2315 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctmtcact

SEQ ID NO: 2316 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctmtcact

SEQ ID NO: 2317 - DNA, 27 bp, Artificial Sequence
  Description of Artificial Sequence: Synthetic oligonucleotide
cagswmtacgataatywccctmtcact

SEQ ID NO: 2318 - DNA, 27 bp, Artificial Sequence
  Description of Artificial Sequence: Synthetic oligonucleotide
swmswmtacgataatctccctwggact

SEQ ID NO: 2319 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctwggact

SEQ ID NO: 2320 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctwggact

SEQ ID NO: 2321 - DNA, 27 bp, Artificial Sequence
  Description of Artificial Sequence: Synthetic oligonucleotide
cagcagbhcgataatywccctwggact

SEQ ID NO: 2322 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctwggact

SEQ ID NO: 2323 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctwggact

SEQ ID NO: 2324 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctwggact

SEQ ID NO: 2325 - DNA, 27 bp, Artificial Sequence
  Description of Artificial Sequence: Synthetic oligonucleotide
swmcagbhcgataatctccctwggact

SEQ ID NO: 2326 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctwggact

SEQ ID NO: 2327 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctwggact

SEQ ID NO: 2328 - DNA, 27 bp, Artificial Sequence
  Description of Artificial Sequence: Synthetic oligonucleotide
swmcagtacgataatywccctwggact

SEQ ID NO: 2329 - DNA, 27 bp, Artificial Sequence
  Description of Artificial Sequence: Synthetic oligonucleotide
cagswmbhcgataatctccctwggact

SEQ ID NO: 2330 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctwggact

SEQ ID NO: 2331 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctwggact

SEQ ID NO: 2332 - DNA, 27 bp, Artificial Sequence
  Description of Artificial Sequence: Synthetic oligonucleotide
cagswmtacgataatywccctwggact

SEQ ID NO: 2333 - DNA, 27 bp, Artificial Sequence
  Description of Artificial Sequence: Synthetic oligonucleotide
swmswmtacgataatctccctcctact

SEQ ID NO: 2334 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctcctact

SEQ ID NO: 2335 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctcctact

SEQ ID NO: 2336 - DNA, 27 bp, Artificial Sequence
  Description of Artificial Sequence: Synthetic oligonucleotide
cagcagbhcgataatywccctcctact

SEQ ID NO: 2337 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctcctact

SEQ ID NO: 2338 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctcctact

SEQ ID NO: 2339 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctcctact

SEQ ID NO: 2340 - DNA, 27 bp, Artificial Sequence
  Description of Artificial Sequence: Synthetic oligonucleotide
swmcagbhcgataatctccctcctact

SEQ ID NO: 2341 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctcctact

SEQ ID NO: 2342 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctcctact

SEQ ID NO: 2343 - DNA, 27 bp, Artificial Sequence
  Description of Artificial Sequence: Synthetic oligonucleotide
swmcagtacgataatywccctcctact

SEQ ID NO: 2344 - DNA, 27 bp, Artificial Sequence
  Description of Artificial Sequence: Synthetic oligonucleotide
cagswmbhcgataatctccctcctact

SEQ ID NO: 2345 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctcctact

SEQ ID NO: 2346 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctcctact

SEQ ID NO: 2347 - DNA, 27 bp, Artificial Sequence
  Description of Artificial Sequence: Synthetic oligonucleotide
cagswmtacgataatywccctcctact

SEQ ID NO: 2348 - DNA, 27 bp, Artificial Sequence
  Description of Artificial Sequence: Synthetic oligonucleotide
swmswmagctacagtactcctmtcact

SEQ ID NO: 2349 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctmtcact

SEQ ID NO: 2350 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctmtcact

SEQ ID NO: 2351 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctmtcact

SEQ ID NO: 2352 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctmtcact

SEQ ID NO: 2353 - DNA, 27 bp, Artificial Sequence
  Description of Artificial Sequence: Synthetic oligonucleotide
cagcaaagcbhcagtbhccctmtcact

SEQ ID NO: 2354 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctmtcact

SEQ ID NO: 2355 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctmtcact

SEQ ID NO: 2356 - DNA, 27 bp, Artificial Sequence
  Description of Artificial Sequence: Synthetic oligonucleotide
swmcaaagcbhcagtactcctmtcact

SEQ ID NO: 2357 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctmtcact

SEQ ID NO: 2358 - DNA, 27 bp, Artificial Sequence
  Description of Artificial Sequence: Synthetic oligonucleotide
swmcaaagctacagtbhccctmtcact

SEQ ID NO: 2359 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctmtcact

SEQ ID NO: 2360 - DNA, 27 bp, Artificial Sequence
  Description of Artificial Sequence: Synthetic oligonucleotide
cagswmagcbhcagtactcctmtcact

SEQ ID NO: 2361 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctmtcact

SEQ ID NO: 2362 - DNA, 27 bp, Artificial Sequence
  Description of Artificial Sequence: Synthetic oligonucleotide
cagswmagctacagtbhccctmtcact

SEQ ID NO: 2363 - DNA, 27 bp, Artificial Sequence
  Description of Artificial Sequence: Synthetic oligonucleotide
swmswmagctacagtactcctwggact

SEQ ID NO: 2364 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctwggact

SEQ ID NO: 2365 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctwggact

SEQ ID NO: 2366 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctwggact

SEQ ID NO: 2367 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctwggact

SEQ ID NO: 2368 - DNA, 27 bp, Artificial Sequence
  Description of Artificial Sequence: Synthetic oligonucleotide
cagcaaagcbhcagtbhccctwggact

SEQ ID NO: 2369 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctwggact

SEQ ID NO: 2370 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctwggact

SEQ ID NO: 2371 - DNA, 27 bp, Artificial Sequence
  Description of Artificial Sequence: Synthetic oligonucleotide
swmcaaagcbhcagtactcctwggact

SEQ ID NO: 2372 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctwggact

SEQ ID NO: 2373 - DNA, 27 bp, Artificial Sequence
  Description of Artificial Sequence: Synthetic oligonucleotide
swmcaaagctacagtbhccctwggact

SEQ ID NO: 2374 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctwggact

SEQ ID NO: 2375 - DNA, 27 bp, Artificial Sequence
  Description of Artificial Sequence: Synthetic oligonucleotide
cagswmagcbhcagtactcctwggact

SEQ ID NO: 2376 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctwggact

SEQ ID NO: 2377 - DNA, 27 bp, Artificial Sequence
  Description of Artificial Sequence: Synthetic oligonucleotide
cagswmagctacagtbhccctwggact

SEQ ID NO: 2378 - DNA, 27 bp, Artificial Sequence
  Description of Artificial Sequence: Synthetic oligonucleotide
swmswmagctacagtactcctcctact

SEQ ID NO: 2379 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctcctact

SEQ ID NO: 2380 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctcctact

SEQ ID NO: 2381 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctcctact

SEQ ID NO: 2382 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctcctact

SEQ ID NO: 2383 - DNA, 27 bp, Artificial Sequence
  Description of Artificial Sequence: Synthetic oligonucleotide
cagcaaagcbhcagtbhccctcctact

SEQ ID NO: 2384 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctcctact

SEQ ID NO: 2385 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctcctact

SEQ ID NO: 2386 - DNA, 27 bp, Artificial Sequence
  Description of Artificial Sequence: Synthetic oligonucleotide
swmcaaagcbhcagtactcctcctact

SEQ ID NO: 2387 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctcctact

SEQ ID NO: 2388 - DNA, 27 bp, Artificial Sequence
  Description of Artificial Sequence: Synthetic oligonucleotide
swmcaaagctacagtbhccctcctact

SEQ ID NO: 2389 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctcctact

SEQ ID NO: 2390 - DNA, 27 bp, Artificial Sequence
  Description of Artificial Sequence: Synthetic oligonucleotide
cagswmagcbhcagtactcctcctact

SEQ ID NO: 2391 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctcctact

SEQ ID NO: 2392 - DNA, 27 bp, Artificial Sequence
  Description of Artificial Sequence: Synthetic oligonucleotide
cagswmagctacagtbhccctcctact

SEQ ID NO: 2393 - DNA, 27 bp, Artificial Sequence
  Description of Artificial Sequence: Synthetic oligonucleotide
dtsswmgcactccagactccttwcact

SEQ ID NO: 2394 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactccttwcact

SEQ ID NO: 2395 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactccttwcact

SEQ ID NO: 2396 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbcccttwcact

SEQ ID NO: 2397 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactccttwcact

SEQ ID NO: 2398 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbcccttwcact

SEQ ID NO: 2399 - DNA, 27 bp, Artificial Sequence
  Description of Artificial Sequence: Synthetic oligonucleotide
atgcaggcactcsrmvbcccttwcact

SEQ ID NO: 2400 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactccttwcact

SEQ ID NO: 2401 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactccttwcact

SEQ ID NO: 2402 - DNA, 27 bp, Artificial Sequence
  Description of Artificial Sequence: Synthetic oligonucleotide
dtscaggcactcsrmactccttwcact

SEQ ID NO: 2403 - DNA, 27 bp, Artificial Sequence
  Description of Artificial Sequence: Synthetic oligonucleotide
dtscaggcactccagvbcccttwcact

SEQ ID NO: 2404 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactccttwcact

SEQ ID NO: 2405 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactccttwcact

SEQ ID NO: 2406 - DNA, 27 bp, Artificial Sequence
  Description of Artificial Sequence: Synthetic oligonucleotide
atgswmgcactcsrmactccttwcact

SEQ ID NO: 2407 - DNA, 27 bp, Artificial Sequence
  Description of Artificial Sequence: Synthetic oligonucleotide
atgswmgcactccagvbcccttwcact

SEQ ID NO: 2408 - DNA, 27 bp, Artificial Sequence
  Description of Artificial Sequence: Synthetic oligonucleotide
dtsswmgcactccagactcctmtcact

SEQ ID NO: 2409 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctmtcact

SEQ ID NO: 2410 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctmtcact

SEQ ID NO: 2411 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctmtcact

SEQ ID NO: 2412 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctmtcact

SEQ ID NO: 2413 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctmtcact

SEQ ID NO: 2414 - DNA, 27 bp, Artificial Sequence
  Description of Artificial Sequence: Synthetic oligonucleotide
atgcaggcactcsrmvbccctmtcact

SEQ ID NO: 2415 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctmtcact

SEQ ID NO: 2416 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctmtcact

SEQ ID NO: 2417 - DNA, 27 bp, Artificial Sequence
  Description of Artificial Sequence: Synthetic oligonucleotide
dtscaggcactcsrmactcctmtcact

SEQ ID NO: 2418 - DNA, 27 bp, Artificial Sequence
  Description of Artificial Sequence: Synthetic oligonucleotide
dtscaggcactccagvbccctmtcact

SEQ ID NO: 2419 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctmtcact

SEQ ID NO: 2420 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctmtcact

SEQ ID NO: 2421 - DNA, 27 bp, Artificial Sequence
  Description of Artificial Sequence: Synthetic oligonucleotide
atgswmgcactcsrmactcctmtcact

SEQ ID NO: 2422 - DNA, 27 bp, Artificial Sequence
  Description of Artificial Sequence: Synthetic oligonucleotide
atgswmgcactccagvbccctmtcact

SEQ ID NO: 2423 - DNA, 27 bp, Artificial Sequence
  Description of Artificial Sequence: Synthetic oligonucleotide
dtsswmgcactccagactcctwggact

SEQ ID NO: 2424 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctwggact

SEQ ID NO: 2425 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctwggact

SEQ ID NO: 2426 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctwggact

SEQ ID NO: 2427 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctwggact

SEQ ID NO: 2428 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctwggact

SEQ ID NO: 2429 - DNA, 27 bp, Artificial Sequence
  Description of Artificial Sequence: Synthetic oligonucleotide
atgcaggcactcsrmvbccctwggact

SEQ ID NO: 2430 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctwggact

SEQ ID NO: 2431 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctwggact

SEQ ID NO: 2432 - DNA, 27 bp, Artificial Sequence
  Description of Artificial Sequence: Synthetic oligonucleotide
dtscaggcactcsrmactcctwggact

SEQ ID NO: 2433 - DNA, 27 bp, Artificial Sequence
  Description of Artificial Sequence: Synthetic oligonucleotide
dtscaggcactccagvbccctwggact

SEQ ID NO: 2434 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctwggact

SEQ ID NO: 2435 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctwggact

SEQ ID NO: 2436 - DNA, 27 bp, Artificial Sequence
  Description of Artificial Sequence: Synthetic oligonucleotide
atgswmgcactcsrmactcctwggact

SEQ ID NO: 2437 - DNA, 27 bp, Artificial Sequence
  Description of Artificial Sequence: Synthetic oligonucleotide
atgswmgcactccagvbccctwggact

SEQ ID NO: 2438 - DNA, 27 bp, Artificial Sequence
  Description of Artificial Sequence: Synthetic oligonucleotide
dtsswmgcactccagactcctcctact

SEQ ID NO: 2439 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctcctact

SEQ ID NO: 2440 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctcctact

SEQ ID NO: 2441 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctcctact

SEQ ID NO: 2442 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctcctact

SEQ ID NO: 2443 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctcctact

SEQ ID NO: 2444 - DNA, 27 bp, Artificial Sequence
  Description of Artificial Sequence: Synthetic oligonucleotide
atgcaggcactcsrmvbccctcctact

SEQ ID NO: 2445 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctcctact

SEQ ID NO: 2446 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctcctact

SEQ ID NO: 2447 - DNA, 27 bp, Artificial Sequence
  Description of Artificial Sequence: Synthetic oligonucleotide
dtscaggcactcsrmactcctcctact

SEQ ID NO: 2448 - DNA, 27 bp, Artificial Sequence
  Description of Artificial Sequence: Synthetic oligonucleotide
dtscaggcactccagvbccctcctact

SEQ ID NO: 2449 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctcctact

SEQ ID NO: 2450 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctcctact

SEQ ID NO: 2451 - DNA, 27 bp, Artificial Sequence
  Description of Artificial Sequence: Synthetic oligonucleotide
atgswmgcactcsrmactcctcctact

SEQ ID NO: 2452 - DNA, 27 bp, Artificial Sequence
  Description of Artificial Sequence: Synthetic oligonucleotide
atgswmgcactccagvbccctcctact

SEQ ID NO: 2453 - DNA, 27 bp, Artificial Sequence
  Description of Artificial Sequence: Synthetic oligonucleotide
swmswmagaagtaattggccttwcact

SEQ ID NO: 2454 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggccttwcact

SEQ ID NO: 2455 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggccttwcact

SEQ ID NO: 2456 - DNA, 27 bp, Artificial Sequence
  Description of Artificial Sequence: Synthetic oligonucleotide
cagcagbhcagtaatywcccttwcact

SEQ ID NO: 2457 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggccttwcact

SEQ ID NO: 2458 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywcccttwcact

SEQ ID NO: 2459 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywcccttwcact

SEQ ID NO: 2460 - DNA, 27 bp, Artificial Sequence
  Description of Artificial Sequence: Synthetic oligonucleotide
swmcagbhcagtaattggccttwcact

SEQ ID NO: 2461 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggccttwcact

SEQ ID NO: 2462 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggccttwcact

SEQ ID NO: 2463 - DNA, 27 bp, Artificial Sequence
  Description of Artificial Sequence: Synthetic oligonucleotide
swmcagagaagtaatywcccttwcact

SEQ ID NO: 2464 - DNA, 27 bp, Artificial Sequence
  Description of Artificial Sequence: Synthetic oligonucleotide
cagswmbhcagtaattggccttwcact

SEQ ID NO: 2465 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggccttwcact

SEQ ID NO: 2466 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggccttwcact

SEQ ID NO: 2467 - DNA, 27 bp, Artificial Sequence
  Description of Artificial Sequence: Synthetic oligonucleotide
cagswmagaagtaatywcccttwcact

SEQ ID NO: 2468 - DNA, 27 bp, Artificial Sequence
  Description of Artificial Sequence: Synthetic oligonucleotide
swmswmagaagtaattggcctmtcact

SEQ ID NO: 2469 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctmtcact

SEQ ID NO: 2470 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctmtcact

SEQ ID NO: 2471 - DNA, 27 bp, Artificial Sequence
  Description of Artificial Sequence: Synthetic oligonucleotide
cagcagbhcagtaatywccctmtcact

SEQ ID NO: 2472 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctmtcact

SEQ ID NO: 2473 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctmtcact

SEQ ID NO: 2474 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctmtcact

SEQ ID NO: 2475 - DNA, 27 bp, Artificial Sequence
  Description of Artificial Sequence: Synthetic oligonucleotide
swmcagbhcagtaattggcctmtcact

SEQ ID NO: 2476 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctmtcact

SEQ ID NO: 2477 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctmtcact

SEQ ID NO: 2478 - DNA, 27 bp, Artificial Sequence
  Description of Artificial Sequence: Synthetic oligonucleotide
swmcagagaagtaatywccctmtcact

SEQ ID NO: 2479 - DNA, 27 bp, Artificial Sequence
  Description of Artificial Sequence: Synthetic oligonucleotide
cagswmbhcagtaattggcctmtcact

SEQ ID NO: 2480 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctmtcact

SEQ ID NO: 2481 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctmtcact

SEQ ID NO: 2482 - DNA, 27 bp, Artificial Sequence
  Description of Artificial Sequence: Synthetic oligonucleotide
cagswmagaagtaatywccctmtcact

SEQ ID NO: 2483 - DNA, 27 bp, Artificial Sequence
  Description of Artificial Sequence: Synthetic oligonucleotide
swmswmagaagtaattggcctwggact

SEQ ID NO: 2484 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctwggact

SEQ ID NO: 2485 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctwggact

SEQ ID NO: 2486 - DNA, 27 bp, Artificial Sequence
  Description of Artificial Sequence: Synthetic oligonucleotide
cagcagbhcagtaatywccctwggact

SEQ ID NO: 2487 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctwggact

SEQ ID NO: 2488 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctwggact

SEQ ID NO: 2489 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctwggact

SEQ ID NO: 2490 - DNA, 27 bp, Artificial Sequence
  Description of Artificial Sequence: Synthetic oligonucleotide
swmcagbhcagtaattggcctwggact

SEQ ID NO: 2491 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctwggact

SEQ ID NO: 2492 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctwggact

SEQ ID NO: 2493 - DNA, 27 bp, Artificial Sequence
  Description of Artificial Sequence: Synthetic oligonucleotide
swmcagagaagtaatywccctwggact

SEQ ID NO: 2494 - DNA, 27 bp, Artificial Sequence
  Description of Artificial Sequence: Synthetic oligonucleotide
cagswmbhcagtaattggcctwggact

SEQ ID NO: 2495 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctwggact

SEQ ID NO: 2496 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctwggact

SEQ ID NO: 2497 - DNA, 27 bp, Artificial Sequence
  Description of Artificial Sequence: Synthetic oligonucleotide
cagswmagaagtaatywccctwggact

SEQ ID NO: 2498 - DNA, 27 bp, Artificial Sequence
  Description of Artificial Sequence: Synthetic oligonucleotide
swmswmagaagtaattggcctcctact

SEQ ID NO: 2499 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctcctact

SEQ ID NO: 2500 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctcctact

SEQ ID NO: 2501 - DNA, 27 bp, Artificial Sequence
  Description of Artificial Sequence: Synthetic oligonucleotide
cagcagbhcagtaatywccctcctact

SEQ ID NO: 2502 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctcctact

SEQ ID NO: 2503 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctcctact

SEQ ID NO: 2504 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctcctact

SEQ ID NO: 2505 - DNA, 27 bp, Artificial Sequence
  Description of Artificial Sequence: Synthetic oligonucleotide
swmcagbhcagtaattggcctcctact

SEQ ID NO: 2506 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctcctact

SEQ ID NO: 2507 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctcctact

SEQ ID NO: 2508 - DNA, 27 bp, Artificial Sequence
  Description of Artificial Sequence: Synthetic oligonucleotide
swmcagagaagtaatywccctcctact

SEQ ID NO: 2509 - DNA, 27 bp, Artificial Sequence
  Description of Artificial Sequence: Synthetic oligonucleotide
cagswmbhcagtaattggcctcctact

SEQ ID NO: 2510 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctcctact

SEQ ID NO: 2511 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctcctact

SEQ ID NO: 2512 - DNA, 27 bp, Artificial Sequence
  Description of Artificial Sequence: Synthetic oligonucleotide
cagswmagaagtaatywccctcctact

SEQ ID NO: 2513 - DNA, 27 bp, Artificial Sequence
  Description of Artificial Sequence: Synthetic oligonucleotide
swmswmtacaataattggccttwcact

SEQ ID NO: 2514 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggccttwcact

SEQ ID NO: 2515 - DNA, 27 bp, Artificial Sequence
  Description of Artificial Sequence: Synthetic oligonucleotide
cagcagbhcaataatywcccttwcact

SEQ ID NO: 2516 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggccttwcact

SEQ ID NO: 2517 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywcccttwcact

SEQ ID NO: 2518 - DNA, 27 bp, Artificial Sequence
  Description of Artificial Sequence: Synthetic oligonucleotide
swmcagbhcaataattggccttwcact

SEQ ID NO: 2519 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggccttwcact

SEQ ID NO: 2520 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggccttwcact

SEQ ID NO: 2521 - DNA, 27 bp, Artificial Sequence
  Description of Artificial Sequence: Synthetic oligonucleotide
swmcagtacaataatywcccttwcact

SEQ ID NO: 2522 - DNA, 27 bp, Artificial Sequence
  Description of Artificial Sequence: Synthetic oligonucleotide
cagswmbhcaataattggccttwcact

SEQ ID NO: 2523 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggccttwcact

SEQ ID NO: 2524 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggccttwcact

SEQ ID NO: 2525 - DNA, 27 bp, Artificial Sequence
  Description of Artificial Sequence: Synthetic oligonucleotide
cagswmtacaataatywcccttwcact

SEQ ID NO: 2526 - DNA, 27 bp, Artificial Sequence
  Description of Artificial Sequence: Synthetic oligonucleotide
swmswmtacaataattggcctmtcact

SEQ ID NO: 2527 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctmtcact

SEQ ID NO: 2528 - DNA, 27 bp, Artificial Sequence
  Description of Artificial Sequence: Synthetic oligonucleotide
cagcagbhcaataatywccctmtcact

SEQ ID NO: 2529 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctmtcact

SEQ ID NO: 2530 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctmtcact

SEQ ID NO: 2531 - DNA, 27 bp, Artificial Sequence
  Description of Artificial Sequence: Synthetic oligonucleotide
swmcagbhcaataattggcctmtcact

SEQ ID NO: 2532 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctmtcact

SEQ ID NO: 2533 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctmtcact

SEQ ID NO: 2534 - DNA, 27 bp, Artificial Sequence
  Description of Artificial Sequence: Synthetic oligonucleotide
swmcagtacaataatywccctmtcact

SEQ ID NO: 2535 - DNA, 27 bp, Artificial Sequence
  Description of Artificial Sequence: Synthetic oligonucleotide
cagswmbhcaataattggcctmtcact

SEQ ID NO: 2536 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctmtcact

SEQ ID NO: 2537 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctmtcact

SEQ ID NO: 2538 - DNA, 27 bp, Artificial Sequence
  Description of Artificial Sequence: Synthetic oligonucleotide
cagswmtacaataatywccctmtcact

SEQ ID NO: 2539 - DNA, 27 bp, Artificial Sequence
  Description of Artificial Sequence: Synthetic oligonucleotide
swmswmtacaataattggcctwggact

SEQ ID NO: 2540 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctwggact

SEQ ID NO: 2541 - DNA, 27 bp, Artificial Sequence
  Description of Artificial Sequence: Synthetic oligonucleotide
cagcagbhcaataatywccctwggact

SEQ ID NO: 2542 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctwggact

SEQ ID NO: 2543 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctwggact

SEQ ID NO: 2544 - DNA, 27 bp, Artificial Sequence
  Description of Artificial Sequence: Synthetic oligonucleotide
swmcagbhcaataattggcctwggact

SEQ ID NO: 2545 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctwggact

SEQ ID NO: 2546 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctwggact

SEQ ID NO: 2547 - DNA, 27 bp, Artificial Sequence
  Description of Artificial Sequence: Synthetic oligonucleotide
swmcagtacaataatywccctwggact

SEQ ID NO: 2548 - DNA, 27 bp, Artificial Sequence
  Description of Artificial Sequence: Synthetic oligonucleotide
cagswmbhcaataattggcctwggact

SEQ ID NO: 2549 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctwggact

SEQ ID NO: 2550 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctwggact

SEQ ID NO: 2551 - DNA, 27 bp, Artificial Sequence
  Description of Artificial Sequence: Synthetic oligonucleotide
cagswmtacaataatywccctwggact

SEQ ID NO: 2552 - DNA, 27 bp, Artificial Sequence
  Description of Artificial Sequence: Synthetic oligonucleotide
swmswmtacaataattggcctcctact

SEQ ID NO: 2553 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctcctact

SEQ ID NO: 2554 - DNA, 27 bp, Artificial Sequence
  Description of Artificial Sequence: Synthetic oligonucleotide
cagcagbhcaataatywccctcctact

SEQ ID NO: 2555 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctcctact

SEQ ID NO: 2556 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctcctact

SEQ ID NO: 2557 - DNA, 27 bp, Artificial Sequence
  Description of Artificial Sequence: Synthetic oligonucleotide
swmcagbhcaataattggcctcctact

SEQ ID NO: 2558 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctcctact

SEQ ID NO: 2559 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctcctact

SEQ ID NO: 2560 - DNA, 27 bp, Artificial Sequence
  Description of Artificial Sequence: Synthetic oligonucleotide
swmcagtacaataatywccctcctact

SEQ ID NO: 2561 - DNA, 27 bp, Artificial Sequence
  Description of Artificial Sequence: Synthetic oligonucleotide
cagswmbhcaataattggcctcctact

SEQ ID NO: 2562 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctcctact

SEQ ID NO: 2563 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctcctact

SEQ ID NO: 2564 - DNA, 27 bp, Artificial Sequence
  Description of Artificial Sequence: Synthetic oligonucleotide
cagswmtacaataatywccctcctact

SEQ ID NO: 2565 - DNA, 27 bp, Artificial Sequence
  Description of Artificial Sequence: Synthetic oligonucleotide
swmswmtacggaagtagtccttwcact

SEQ ID NO: 2566 - DNA, 27 bp, Artificial Sequence
  Description of Artificial Sequence: Synthetic oligonucleotide
cagcagbhcbhcagtagtccttwcact

SEQ ID NO: 2567 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtccttwcact

SEQ ID NO: 2568 - DNA, 27 bp, Artificial Sequence
  Description of Artificial Sequence: Synthetic oligonucleotide
cagcagbhcggaagtbhcccttwcact

SEQ ID NO: 2569 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtccttwcact

SEQ ID NO: 2570 - DNA, 27 bp, Artificial Sequence
  Description of Artificial Sequence: Synthetic oligonucleotide
cagcagtacbhcagtbhcccttwcact

SEQ ID NO: 2571 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhcccttwcact

SEQ ID NO: 2572 - DNA, 27 bp, Artificial Sequence
  Description of Artificial Sequence: Synthetic oligonucleotide
swmcagbhcggaagtagtccttwcact

SEQ ID NO: 2573 - DNA, 27 bp, Artificial Sequence
  Description of Artificial Sequence: Synthetic oligonucleotide
swmcagtacbhcagtagtccttwcact

SEQ ID NO: 2574 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtccttwcact

SEQ ID NO: 2575 - DNA, 27 bp, Artificial Sequence
  Description of Artificial Sequence: Synthetic oligonucleotide
swmcagtacggaagtbhcccttwcact

SEQ ID NO: 2576 - DNA, 27 bp, Artificial Sequence
  Description of Artificial Sequence: Synthetic oligonucleotide
cagswmbhcggaagtagtccttwcact

SEQ ID NO: 2577 - DNA, 27 bp, Artificial Sequence
  Description of Artificial Sequence: Synthetic oligonucleotide
cagswmtacbhcagtagtccttwcact

SEQ ID NO: 2578 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtccttwcact

SEQ ID NO: 2579 - DNA, 27 bp, Artificial Sequence
  Description of Artificial Sequence: Synthetic oligonucleotide
cagswmtacggaagtbhcccttwcact

SEQ ID NO: 2580 - DNA, 27 bp, Artificial Sequence
  Description of Artificial Sequence: Synthetic oligonucleotide
swmswmtacggaagtagtcctmtcact

SEQ ID NO: 2581 - DNA, 27 bp, Artificial Sequence
  Description of Artificial Sequence: Synthetic oligonucleotide
cagcagbhcbhcagtagtcctmtcact

SEQ ID NO: 2582 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctmtcact

SEQ ID NO: 2583 - DNA, 27 bp, Artificial Sequence
  Description of Artificial Sequence: Synthetic oligonucleotide
cagcagbhcggaagtbhccctmtcact

SEQ ID NO: 2584 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctmtcact

SEQ ID NO: 2585 - DNA, 27 bp, Artificial Sequence
  Description of Artificial Sequence: Synthetic oligonucleotide
cagcagtacbhcagtbhccctmtcact

SEQ ID NO: 2586 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctmtcact

SEQ ID NO: 2587 - DNA, 27 bp, Artificial Sequence
  Description of Artificial Sequence: Synthetic oligonucleotide
swmcagbhcggaagtagtcctmtcact

SEQ ID NO: 2588 - DNA, 27 bp, Artificial Sequence
  Description of Artificial Sequence: Synthetic oligonucleotide
swmcagtacbhcagtagtcctmtcact

SEQ ID NO: 2589 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctmtcact

SEQ ID NO: 2590 - DNA, 27 bp, Artificial Sequence
  Description of Artificial Sequence: Synthetic oligonucleotide
swmcagtacggaagtbhccctmtcact

SEQ ID NO: 2591 - DNA, 27 bp, Artificial Sequence
  Description of Artificial Sequence: Synthetic oligonucleotide
cagswmbhcggaagtagtcctmtcact

SEQ ID NO: 2592 - DNA, 27 bp, Artificial Sequence
  Description of Artificial Sequence: Synthetic oligonucleotide
cagswmtacbhcagtagtcctmtcact

SEQ ID NO: 2593 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctmtcact

SEQ ID NO: 2594 - DNA, 27 bp, Artificial Sequence
  Description of Artificial Sequence: Synthetic oligonucleotide
cagswmtacggaagtbhccctmtcact

SEQ ID NO: 2595 - DNA, 27 bp, Artificial Sequence
  Description of Artificial Sequence: Synthetic oligonucleotide
swmswmtacggaagtagtcctwggact

SEQ ID NO: 2596 - DNA, 27 bp, Artificial Sequence
  Description of Artificial Sequence: Synthetic oligonucleotide
cagcagbhcbhcagtagtcctwggact

SEQ ID NO: 2597 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctwggact

SEQ ID NO: 2598 - DNA, 27 bp, Artificial Sequence
  Description of Artificial Sequence: Synthetic oligonucleotide
cagcagbhcggaagtbhccctwggact

SEQ ID NO: 2599 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctwggact

SEQ ID NO: 2600 - DNA, 27 bp, Artificial Sequence
  Description of Artificial Sequence: Synthetic oligonucleotide
cagcagtacbhcagtbhccctwggact

SEQ ID NO: 2601 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctwggact

SEQ ID NO: 2602 - DNA, 27 bp, Artificial Sequence
  Description of Artificial Sequence: Synthetic oligonucleotide
swmcagbhcggaagtagtcctwggact

SEQ ID NO: 2603 - DNA, 27 bp, Artificial Sequence
  Description of Artificial Sequence: Synthetic oligonucleotide
swmcagtacbhcagtagtcctwggact

SEQ ID NO: 2604 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctwggact

SEQ ID NO: 2605 - DNA, 27 bp, Artificial Sequence
  Description of Artificial Sequence: Synthetic oligonucleotide
swmcagtacggaagtbhccctwggact

SEQ ID NO: 2606 - DNA, 27 bp, Artificial Sequence
  Description of Artificial Sequence: Synthetic oligonucleotide
cagswmbhcggaagtagtcctwggact

SEQ ID NO: 2607 - DNA, 27 bp, Artificial Sequence
  Description of Artificial Sequence: Synthetic oligonucleotide
cagswmtacbhcagtagtcctwggact

SEQ ID NO: 2608 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctwggact

SEQ ID NO: 2609 - DNA, 27 bp, Artificial Sequence
  Description of Artificial Sequence: Synthetic oligonucleotide
cagswmtacggaagtbhccctwggact

SEQ ID NO: 2610 - DNA, 27 bp, Artificial Sequence
  Description of Artificial Sequence: Synthetic oligonucleotide
swmswmtacggaagtagtcctcctact

SEQ ID NO: 2611 - DNA, 27 bp, Artificial Sequence
  Description of Artificial Sequence: Synthetic oligonucleotide
cagcagbhcbhcagtagtcctcctact

SEQ ID NO: 2612 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctcctact

SEQ ID NO: 2613 - DNA, 27 bp, Artificial Sequence
  Description of Artificial Sequence: Synthetic oligonucleotide
cagcagbhcggaagtbhccctcctact

SEQ ID NO: 2614 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctcctact

SEQ ID NO: 2615 - DNA, 27 bp, Artificial Sequence
  Description of Artificial Sequence: Synthetic oligonucleotide
cagcagtacbhcagtbhccctcctact

SEQ ID NO: 2616 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctcctact

SEQ ID NO: 2617 - DNA, 27 bp, Artificial Sequence
  Description of Artificial Sequence: Synthetic oligonucleotide
swmcagbhcggaagtagtcctcctact

SEQ ID NO: 2618 - DNA, 27 bp, Artificial Sequence
  Description of Artificial Sequence: Synthetic oligonucleotide
swmcagtacbhcagtagtcctcctact

SEQ ID NO: 2619 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctcctact

SEQ ID NO: 2620 - DNA, 27 bp, Artificial Sequence
  Description of Artificial Sequence: Synthetic oligonucleotide
swmcagtacggaagtbhccctcctact

SEQ ID NO: 2621 - DNA, 27 bp, Artificial Sequence
  Description of Artificial Sequence: Synthetic oligonucleotide
cagswmbhcggaagtagtcctcctact

SEQ ID NO: 2622 - DNA, 27 bp, Artificial Sequence
  Description of Artificial Sequence: Synthetic oligonucleotide
cagswmtacbhcagtagtcctcctact

SEQ ID NO: 2623 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctcctact

SEQ ID NO: 2624 - DNA, 27 bp, Artificial Sequence
  Description of Artificial Sequence: Synthetic oligonucleotide
cagswmtacggaagtbhccctcctact

SEQ ID NO: 2625 - DNA, 27 bp, Artificial Sequence
  Description of Artificial Sequence: Synthetic oligonucleotide
cagcagbhcvrmmbctacycttwcact

SEQ ID NO: 2626 - DNA, 27 bp, Artificial Sequence
  Description of Artificial Sequence: Synthetic oligonucleotide
cagcagbhcvrmmbctacyctmtcact

SEQ ID NO: 2627 - DNA, 27 bp, Artificial Sequence
  Description of Artificial Sequence: Synthetic oligonucleotide
cagcagbhcvrmmbctacyctwggact

SEQ ID NO: 2628 - DNA, 27 bp, Artificial Sequence
  Description of Artificial Sequence: Synthetic oligonucleotide
cagcagbhcvrmmbctacyctcctact

SEQ ID NO: 2629 - DNA, 27 bp, Artificial Sequence
  Description of Artificial Sequence: Synthetic oligonucleotide
cagcagbhcaatmbcywcycttwcact

SEQ ID NO: 2630 - DNA, 27 bp, Artificial Sequence
  Description of Artificial Sequence: Synthetic oligonucleotide
cagcagbhcaatmbcywcyctmtcact

SEQ ID NO: 2631 - DNA, 27 bp, Artificial Sequence
  Description of Artificial Sequence: Synthetic oligonucleotide
cagcagbhcaatmbcywcyctwggact

SEQ ID NO: 2632 - DNA, 27 bp, Artificial Sequence
  Description of Artificial Sequence: Synthetic oligonucleotide
cagcagbhcaatmbcywcyctcctact

SEQ ID NO: 2633 - DNA, 27 bp, Artificial Sequence
  Description of Artificial Sequence: Synthetic oligonucleotide
cagcagbhcvrmagtywcycttwcact

SEQ ID NO: 2634 - DNA, 27 bp, Artificial Sequence
  Description of Artificial Sequence: Synthetic oligonucleotide
cagcagbhcvrmagtywcyctmtcact

SEQ ID NO: 2635 - DNA, 27 bp, Artificial Sequence
  Description of Artificial Sequence: Synthetic oligonucleotide
cagcagbhcvrmagtywcyctwggact

SEQ ID NO: 2636 - DNA, 27 bp, Artificial Sequence
  Description of Artificial Sequence: Synthetic oligonucleotide
cagcagbhcvrmagtywcyctcctact

SEQ ID NO: 2637 - DNA, 27 bp, Artificial Sequence
  Description of Artificial Sequence: Synthetic oligonucleotide
cagcagtacvrmmbcywcycttwcact

SEQ ID NO: 2638 - DNA, 27 bp, Artificial Sequence
  Description of Artificial Sequence: Synthetic oligonucleotide
cagcagtacvrmmbcywcyctmtcact

SEQ ID NO: 2639 - DNA, 27 bp, Artificial Sequence
  Description of Artificial Sequence: Synthetic oligonucleotide
cagcagtacvrmmbcywcyctwggact

SEQ ID NO: 2640 - DNA, 27 bp, Artificial Sequence
  Description of Artificial Sequence: Synthetic oligonucleotide
cagcagtacvrmmbcywcyctcctact

SEQ ID NO: 2641 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttcccttwcact

SEQ ID NO: 2642 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctmtcact

SEQ ID NO: 2643 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctwggact

SEQ ID NO: 2644 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctcctact

SEQ ID NO: 2645 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywcccttwcact

SEQ ID NO: 2646 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctmtcact

SEQ ID NO: 2647 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctwggact

SEQ ID NO: 2648 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctcctact

SEQ ID NO: 2649 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywcccttwcact

SEQ ID NO: 2650 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctmtcact

SEQ ID NO: 2651 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctwggact

SEQ ID NO: 2652 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctcctact

SEQ ID NO: 2653 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywcccttwcact

SEQ ID NO: 2654 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctmtcact

SEQ ID NO: 2655 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctwggact

SEQ ID NO: 2656 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctcctact

SEQ ID NO: 2657 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctcccttwcact

SEQ ID NO: 2658 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctmtcact

SEQ ID NO: 2659 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctwggact

SEQ ID NO: 2660 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctcctact

SEQ ID NO: 2661 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywcccttwcact

SEQ ID NO: 2662 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctmtcact

SEQ ID NO: 2663 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctwggact

SEQ ID NO: 2664 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctcctact

SEQ ID NO: 2665 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywcccttwcact

SEQ ID NO: 2666 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctmtcact

SEQ ID NO: 2667 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctwggact

SEQ ID NO: 2668 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctcctact

SEQ ID NO: 2669 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywcccttwcact

SEQ ID NO: 2670 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctmtcact

SEQ ID NO: 2671 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctwggact

SEQ ID NO: 2672 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctcctact

SEQ ID NO: 2673 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctmtcact

SEQ ID NO: 2674 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctwggact

SEQ ID NO: 2675 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctcctact

SEQ ID NO: 2676 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctmtcact

SEQ ID NO: 2677 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctwggact

SEQ ID NO: 2678 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctcctact

SEQ ID NO: 2679 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctmtcact

SEQ ID NO: 2680 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctwggact

SEQ ID NO: 2681 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctcctact

SEQ ID NO: 2682 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctmtcact

SEQ ID NO: 2683 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctwggact

SEQ ID NO: 2684 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctcctact

SEQ ID NO: 2685 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactccttwcact

SEQ ID NO: 2686 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctmtcact

SEQ ID NO: 2687 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctwggact

SEQ ID NO: 2688 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctcctact

SEQ ID NO: 2689 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbcccttwcact

SEQ ID NO: 2690 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctmtcact

SEQ ID NO: 2691 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctwggact

SEQ ID NO: 2692 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctcctact

SEQ ID NO: 2693 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbcccttwcact

SEQ ID NO: 2694 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctmtcact

SEQ ID NO: 2695 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctwggact

SEQ ID NO: 2696 - DNA, 27 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctcctact

SEQ ID NO: 2697 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbcccttwcact

SEQ ID NO: 2698 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctmtcact

SEQ ID NO: 2699 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctwggact

SEQ ID NO: 2700 - DNA, 27 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctcctact

SEQ ID NO: 2701 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggccttwcact

SEQ ID NO: 2702 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctmtcact

SEQ ID NO: 2703 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctwggact

SEQ ID NO: 2704 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctcctact

SEQ ID NO: 2705 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywcccttwcact

SEQ ID NO: 2706 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctmtcact

SEQ ID NO: 2707 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctwggact

SEQ ID NO: 2708 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctcctact

SEQ ID NO: 2709 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywcccttwcact

SEQ ID NO: 2710 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctmtcact

SEQ ID NO: 2711 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctwggact

SEQ ID NO: 2712 - DNA, 27 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctcctact

SEQ ID NO: 2713 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywcccttwcact

SEQ ID NO: 2714 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctmtcact

SEQ ID NO: 2715 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctwggact

SEQ ID NO: 2716 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctcctact

SEQ ID NO: 2717 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtccttwcact

SEQ ID NO: 2718 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctmtcact

SEQ ID NO: 2719 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctwggact

SEQ ID NO: 2720 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctcctact

SEQ ID NO: 2721 - DNA, 27 bp, Artificial Sequence
  Description of Artificial Sequence: Synthetic oligonucleotide
cagcagbhcbhcagtbhcccttwcact

SEQ ID NO: 2722 - DNA, 27 bp, Artificial Sequence
  Description of Artificial Sequence: Synthetic oligonucleotide
cagcagbhcbhcagtbhccctmtcact

SEQ ID NO: 2723 - DNA, 27 bp, Artificial Sequence
  Description of Artificial Sequence: Synthetic oligonucleotide
cagcagbhcbhcagtbhccctwggact

SEQ ID NO: 2724 - DNA, 27 bp, Artificial Sequence
  Description of Artificial Sequence: Synthetic oligonucleotide
cagcagbhcbhcagtbhccctcctact

SEQ ID NO: 2725 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhcccttwcact

SEQ ID NO: 2726 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctmtcact

SEQ ID NO: 2727 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctwggact

SEQ ID NO: 2728 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctcctact

SEQ ID NO: 2729 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhcccttwcact

SEQ ID NO: 2730 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctmtcact

SEQ ID NO: 2731 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctwggact

SEQ ID NO: 2732 - DNA, 27 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctcctact

SEQ ID NO: 2733 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactccttwcact

SEQ ID NO: 2734 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctmtcact

SEQ ID NO: 2735 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctwggact

SEQ ID NO: 2736 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctcctact

SEQ ID NO: 2737 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhcccttwcact

SEQ ID NO: 2738 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctmtcact

SEQ ID NO: 2739 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctwggact

SEQ ID NO: 2740 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctcctact

SEQ ID NO: 2741 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhcccttwcact

SEQ ID NO: 2742 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctmtcact

SEQ ID NO: 2743 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctwggact

SEQ ID NO: 2744 - DNA, 27 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctcctact

SEQ ID NO: 2745 - DNA, 75 bp, Artificial Sequence
  Description of Artificial Sequence: Synthetic oligonucleotide
cctgatgattttgcaacttattactgcswmswmtacaatagttacyctccttwcacttttggcggagggaccaag

SEQ ID NO: 2746 - DNA, 75 bp, Artificial Sequence
  Description of Artificial Sequence: Synthetic oligonucleotide
cctgatgattttgcaacttattactgccagcagbhcvrmagttacyctccttwcacttttggcggagggaccaag

SEQ ID NO: 2747 - DNA, 75 bp, Artificial Sequence
  Description of Artificial Sequence: Synthetic oligonucleotide
cctgatgattttgcaacttattactgccagcagbhcaatmbctacyctccttwcacttttggcggagggaccaag

SEQ ID NO: 2748 - DNA, 75 bp, Artificial Sequence
  Description of Artificial Sequence: Synthetic oligonucleotide
cctgatgattttgcaacttattactgccagcagbhcaatagtywcyctccttwcacttttggcggagggaccaag

SEQ ID NO: 2749 - DNA, 75 bp, Artificial Sequence
  Description of Artificial Sequence: Synthetic oligonucleotide
cctgatgattttgcaacttattactgccagcagtacvrmmbctacyctccttwcacttttggcggagggaccaag

SEQ ID NO: 2750 - DNA, 75 bp, Artificial Sequence
  Description of Artificial Sequence: Synthetic oligonucleotide
cctgatgattttgcaacttattactgccagcagtacvrmagtywcyctccttwcacttttggcggagggaccaag

SEQ ID NO: 2751 - DNA, 75 bp, Artificial Sequence
  Description of Artificial Sequence: Synthetic oligonucleotide
cctgatgattttgcaacttattactgccagcagtacaatmbcywcyctccttwcacttttggcggagggaccaag

SEQ ID NO: 2752 - DNA, 75 bp, Artificial Sequence
  Description of Artificial Sequence: Synthetic oligonucleotide
cctgatgattttgcaacttattactgcswmcagbhcaatagttacyctccttwcacttttggcggagggaccaag

SEQ ID NO: 2753 - DNA, 75 bp, Artificial Sequence
  Description of Artificial Sequence: Synthetic oligonucleotide
cctgatgattttgcaacttattactgcswmcagtacvrmagttacyctccttwcacttttggcggagggaccaag

SEQ ID NO: 2754 - DNA, 75 bp, Artificial Sequence
  Description of Artificial Sequence: Synthetic oligonucleotide
cctgatgattttgcaacttattactgcswmcagtacaatmbctacyctccttwcacttttggcggagggaccaag

SEQ ID NO: 2755 - DNA, 75 bp, Artificial Sequence
  Description of Artificial Sequence: Synthetic oligonucleotide
cctgatgattttgcaacttattactgcswmcagtacaatagtywcyctccttwcacttttggcggagggaccaag

SEQ ID NO: 2756 - DNA, 75 bp, Artificial Sequence
  Description of Artificial Sequence: Synthetic oligonucleotide
cctgatgattttgcaacttattactgccagswmbhcaatagttacyctccttwcacttttggcggagggaccaag

SEQ ID NO: 2757 - DNA, 75 bp, Artificial Sequence
  Description of Artificial Sequence: Synthetic oligonucleotide
cctgatgattttgcaacttattactgccagswmtacvrmagttacyctccttwcacttttggcggagggaccaag

SEQ ID NO: 2758 - DNA, 75 bp, Artificial Sequence
  Description of Artificial Sequence: Synthetic oligonucleotide
cctgatgattttgcaacttattactgccagswmtacaatmbctacyctccttwcacttttggcggagggaccaag

SEQ ID NO: 2759 - DNA, 75 bp, Artificial Sequence
  Description of Artificial Sequence: Synthetic oligonucleotide
cctgatgattttgcaacttattactgccagswmtacaatagtywcyctccttwcacttttggcggagggaccaag

SEQ ID NO: 2760 - DNA, 75 bp, Artificial Sequence
  Description of Artificial Sequence: Synthetic oligonucleotide
cctgatgattttgcaacttattactgcswmswmtacaatagttacyctcctmtcacttttggcggagggaccaag

SEQ ID NO: 2761 - DNA, 75 bp, Artificial Sequence
  Description of Artificial Sequence: Synthetic oligonucleotide
cctgatgattttgcaacttattactgccagcagbhcvrmagttacyctcctmtcacttttggcggagggaccaag

SEQ ID NO: 2762 - DNA, 75 bp, Artificial Sequence
  Description of Artificial Sequence: Synthetic oligonucleotide
cctgatgattttgcaacttattactgccagcagbhcaatmbctacyctcctmtcacttttggcggagggaccaag

SEQ ID NO: 2763 - DNA, 75 bp, Artificial Sequence
  Description of Artificial Sequence: Synthetic oligonucleotide
cctgatgattttgcaacttattactgccagcagbhcaatagtywcyctcctmtcacttttggcggagggaccaag

SEQ ID NO: 2764 - DNA, 75 bp, Artificial Sequence
  Description of Artificial Sequence: Synthetic oligonucleotide
cctgatgattttgcaacttattactgccagcagtacvrmmbctacyctcctmtcacttttggcggagggaccaag

SEQ ID NO: 2765 - DNA, 75 bp, Artificial Sequence
  Description of Artificial Sequence: Synthetic oligonucleotide
cctgatgattttgcaacttattactgccagcagtacvrmagtywcyctcctmtcacttttggcggagggaccaag

SEQ ID NO: 2766 - DNA, 75 bp, Artificial Sequence
  Description of Artificial Sequence: Synthetic oligonucleotide
cctgatgattttgcaacttattactgccagcagtacaatmbcywcyctcctmtcacttttggcggagggaccaag

SEQ ID NO: 2767 - DNA, 75 bp, Artificial Sequence
  Description of Artificial Sequence: Synthetic oligonucleotide
cctgatgattttgcaacttattactgcswmcagbhcaatagttacyctcctmtcacttttggcggagggaccaag

SEQ ID NO: 2768 - DNA, 75 bp, Artificial Sequence
  Description of Artificial Sequence: Synthetic oligonucleotide
cctgatgattttgcaacttattactgcswmcagtacvrmagttacyctcctmtcacttttggcggagggaccaag

SEQ ID NO: 2769 - DNA, 75 bp, Artificial Sequence
  Description of Artificial Sequence: Synthetic oligonucleotide
cctgatgattttgcaacttattactgcswmcagtacaatmbctacyctcctmtcacttttggcggagggaccaag

SEQ ID NO: 2770 - DNA, 75 bp, Artificial Sequence
  Description of Artificial Sequence: Synthetic oligonucleotide
cctgatgattttgcaacttattactgcswmcagtacaatagtywcyctcctmtcacttttggcggagggaccaag

SEQ ID NO: 2771 - DNA, 75 bp, Artificial Sequence
  Description of Artificial Sequence: Synthetic oligonucleotide
cctgatgattttgcaacttattactgccagswmbhcaatagttacyctcctmtcacttttggcggagggaccaag

SEQ ID NO: 2772 - DNA, 75 bp, Artificial Sequence
  Description of Artificial Sequence: Synthetic oligonucleotide
cctgatgattttgcaacttattactgccagswmtacvrmagttacyctcctmtcacttttggcggagggaccaag

SEQ ID NO: 2773 - DNA, 75 bp, Artificial Sequence
  Description of Artificial Sequence: Synthetic oligonucleotide
cctgatgattttgcaacttattactgccagswmtacaatmbctacyctcctmtcacttttggcggagggaccaag

SEQ ID NO: 2774 - DNA, 75 bp, Artificial Sequence
  Description of Artificial Sequence: Synthetic oligonucleotide
cctgatgattttgcaacttattactgccagswmtacaatagtywcyctcctmtcacttttggcggagggaccaag

SEQ ID NO: 2775 - DNA, 75 bp, Artificial Sequence
  Description of Artificial Sequence: Synthetic oligonucleotide
cctgatgattttgcaacttattactgcswmswmtacaatagttacyctcctwggacttttggcggagggaccaag

SEQ ID NO: 2776 - DNA, 75 bp, Artificial Sequence
  Description of Artificial Sequence: Synthetic oligonucleotide
cctgatgattttgcaacttattactgccagcagbhcvrmagttacyctcctwggacttttggcggagggaccaag

SEQ ID NO: 2777 - DNA, 75 bp, Artificial Sequence
  Description of Artificial Sequence: Synthetic oligonucleotide
cctgatgattttgcaacttattactgccagcagbhcaatmbctacyctcctwggacttttggcggagggaccaag

SEQ ID NO: 2778 - DNA, 75 bp, Artificial Sequence
  Description of Artificial Sequence: Synthetic oligonucleotide
cctgatgattttgcaacttattactgccagcagbhcaatagtywcyctcctwggacttttggcggagggaccaag

SEQ ID NO: 2779 - DNA, 75 bp, Artificial Sequence
  Description of Artificial Sequence: Synthetic oligonucleotide
cctgatgattttgcaacttattactgccagcagtacvrmmbctacyctcctwggacttttggcggagggaccaag

SEQ ID NO: 2780 - DNA, 75 bp, Artificial Sequence
  Description of Artificial Sequence: Synthetic oligonucleotide
cctgatgattttgcaacttattactgccagcagtacvrmagtywcyctcctwggacttttggcggagggaccaag

SEQ ID NO: 2781 - DNA, 75 bp, Artificial Sequence
  Description of Artificial Sequence: Synthetic oligonucleotide
cctgatgattttgcaacttattactgccagcagtacaatmbcywcyctcctwggacttttggcggagggaccaag

SEQ ID NO: 2782 - DNA, 75 bp, Artificial Sequence
  Description of Artificial Sequence: Synthetic oligonucleotide
cctgatgattttgcaacttattactgcswmcagbhcaatagttacyctcctwggacttttggcggagggaccaag

SEQ ID NO: 2783 - DNA, 75 bp, Artificial Sequence
  Description of Artificial Sequence: Synthetic oligonucleotide
cctgatgattttgcaacttattactgcswmcagtacvrmagttacyctcctwggacttttggcggagggaccaag

SEQ ID NO: 2784 - DNA, 75 bp, Artificial Sequence
  Description of Artificial Sequence: Synthetic oligonucleotide
cctgatgattttgcaacttattactgcswmcagtacaatmbctacyctcctwggacttttggcggagggaccaag

SEQ ID NO: 2785 - DNA, 75 bp, Artificial Sequence
  Description of Artificial Sequence: Synthetic oligonucleotide
cctgatgattttgcaacttattactgcswmcagtacaatagtywcyctcctwggacttttggcggagggaccaag

SEQ ID NO: 2786 - DNA, 75 bp, Artificial Sequence
  Description of Artificial Sequence: Synthetic oligonucleotide
cctgatgattttgcaacttattactgccagswmbhcaatagttacyctcctwggacttttggcggagggaccaag

SEQ ID NO: 2787 - DNA, 75 bp, Artificial Sequence
  Description of Artificial Sequence: Synthetic oligonucleotide
cctgatgattttgcaacttattactgccagswmtacvrmagttacyctcctwggacttttggcggagggaccaag

SEQ ID NO: 2788 - DNA, 75 bp, Artificial Sequence
  Description of Artificial Sequence: Synthetic oligonucleotide
cctgatgattttgcaacttattactgccagswmtacaatmbctacyctcctwggacttttggcggagggaccaag

SEQ ID NO: 2789 - DNA, 75 bp, Artificial Sequence
  Description of Artificial Sequence: Synthetic oligonucleotide
cctgatgattttgcaacttattactgccagswmtacaatagtywcyctcctwggacttttggcggagggaccaag

SEQ ID NO: 2790 - DNA, 75 bp, Artificial Sequence
  Description of Artificial Sequence: Synthetic oligonucleotide
cctgaagattttgcaacttattactgtswmswmgcaaatagtttccctccttwcacttttggcggagggaccaag

SEQ ID NO: 2791 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctccttwcacttttggcggagggaccaag

SEQ ID NO: 2792 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctccttwcacttttggcggagggaccaag

SEQ ID NO: 2793 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctccttwcacttttggcggagggaccaag

SEQ ID NO: 2794 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctccttwcacttttggcggagggaccaag

SEQ ID NO: 2795 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctccttwcacttttggcggagggaccaag

SEQ ID NO: 2796 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctccttwcacttttggcggagggaccaag

SEQ ID NO: 2797 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctccttwcacttttggcggagggaccaag

SEQ ID NO: 2798 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctccttwcacttttggcggagggaccaag

SEQ ID NO: 2799 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctccttwcacttttggcggagggaccaag

SEQ ID NO: 2800 - DNA, 75 bp, Artificial Sequence
  Description of Artificial Sequence: Synthetic oligonucleotide
cctgaagattttgcaacttattactgtswmcaggcaaatagtywccctccttwcacttttggcggagggaccaag

SEQ ID NO: 2801 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctccttwcacttttggcggagggaccaag

SEQ ID NO: 2802 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctccttwcacttttggcggagggaccaag

SEQ ID NO: 2803 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctccttwcacttttggcggagggaccaag

SEQ ID NO: 2804 - DNA, 75 bp, Artificial Sequence
  Description of Artificial Sequence: Synthetic oligonucleotide
cctgaagattttgcaacttattactgtcagswmgcaaatagtywccctccttwcacttttggcggagggaccaag

SEQ ID NO: 2805 - DNA, 75 bp, Artificial Sequence
  Description of Artificial Sequence: Synthetic oligonucleotide
cctgaagattttgcaacttattactgtswmswmgcaaatagtttccctcctmtcacttttggcggagggaccaag

SEQ ID NO: 2806 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctcctmtcacttttggcggagggaccaag

SEQ ID NO: 2807 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctcctmtcacttttggcggagggaccaag

SEQ ID NO: 2808 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctcctmtcacttttggcggagggaccaag

SEQ ID NO: 2809 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctcctmtcacttttggcggagggaccaag

SEQ ID NO: 2810 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctcctmtcacttttggcggagggaccaag

SEQ ID NO: 2811 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctcctmtcacttttggcggagggaccaag

SEQ ID NO: 2812 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctcctmtcacttttggcggagggaccaag

SEQ ID NO: 2813 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctcctmtcacttttggcggagggaccaag

SEQ ID NO: 2814 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctcctmtcacttttggcggagggaccaag

SEQ ID NO: 2815 - DNA, 75 bp, Artificial Sequence
  Description of Artificial Sequence: Synthetic oligonucleotide
cctgaagattttgcaacttattactgtswmcaggcaaatagtywccctcctmtcacttttggcggagggaccaag

SEQ ID NO: 2816 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctcctmtcacttttggcggagggaccaag

SEQ ID NO: 2817 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctcctmtcacttttggcggagggaccaag

SEQ ID NO: 2818 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctcctmtcacttttggcggagggaccaag

SEQ ID NO: 2819 - DNA, 75 bp, Artificial Sequence
  Description of Artificial Sequence: Synthetic oligonucleotide
cctgaagattttgcaacttattactgtcagswmgcaaatagtywccctcctmtcacttttggcggagggaccaag

SEQ ID NO: 2820 - DNA, 75 bp, Artificial Sequence
  Description of Artificial Sequence: Synthetic oligonucleotide
cctgaagattttgcaacttattactgtswmswmgcaaatagtttccctcctwggacttttggcggagggaccaag

SEQ ID NO: 2821 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtttccctcctwggacttttggcggagggaccaag

SEQ ID NO: 2822 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcttccctcctwggacttttggcggagggaccaag

SEQ ID NO: 2823 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagcagrnaaatagtywccctcctwggacttttggcggagggaccaag

SEQ ID NO: 2824 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcttccctcctwggacttttggcggagggaccaag

SEQ ID NO: 2825 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagcaggcanhcagtywccctcctwggacttttggcggagggaccaag

SEQ ID NO: 2826 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagcaggcaaatnhcywccctcctwggacttttggcggagggaccaag

SEQ ID NO: 2827 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtswmcagrnaaatagtttccctcctwggacttttggcggagggaccaag

SEQ ID NO: 2828 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtswmcaggcanhcagtttccctcctwggacttttggcggagggaccaag

SEQ ID NO: 2829 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtswmcaggcaaatnhcttccctcctwggacttttggcggagggaccaag

SEQ ID NO: 2830 - DNA, 75 bp, Artificial Sequence
  Description of Artificial Sequence: Synthetic oligonucleotide
cctgaagattttgcaacttattactgtswmcaggcaaatagtywccctcctwggacttttggcggagggaccaag

SEQ ID NO: 2831 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttattactgtcagswmrnaaatagtttccctcctwggacttttggcggagggaccaag

SEQ ID NO: 2832 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcaacttattactgtcagswmgcanhcagtttccctcctwggacttttggcggagggaccaag

SEQ ID NO: 2833 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttattactgtcagswmgcaaatnhcttccctcctwggacttttggcggagggaccaag

SEQ ID NO: 2834 - DNA, 75 bp, Artificial Sequence
  Description of Artificial Sequence: Synthetic oligonucleotide
cctgaagattttgcaacttattactgtcagswmgcaaatagtywccctcctwggacttttggcggagggaccaag

SEQ ID NO: 2835 - DNA, 75 bp, Artificial Sequence
  Description of Artificial Sequence: Synthetic oligonucleotide
cctgaagatattgcaacatattactgtswmswmtacgataatctccctccttwcacttttggcggagggaccaag

SEQ ID NO: 2836 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctccttwcacttttggcggagggaccaag

SEQ ID NO: 2837 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctccttwcacttttggcggagggaccaag

SEQ ID NO: 2838 - DNA, 75 bp, Artificial Sequence
  Description of Artificial Sequence: Synthetic oligonucleotide
cctgaagatattgcaacatattactgtcagcagbhcgataatywccctccttwcacttttggcggagggaccaag

SEQ ID NO: 2839 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctccttwcacttttggcggagggaccaag

SEQ ID NO: 2840 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctccttwcacttttggcggagggaccaag

SEQ ID NO: 2841 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctccttwcacttttggcggagggaccaag

SEQ ID NO: 2842 - DNA, 75 bp, Artificial Sequence
  Description of Artificial Sequence: Synthetic oligonucleotide
cctgaagatattgcaacatattactgtswmcagbhcgataatctccctccttwcacttttggcggagggaccaag

SEQ ID NO: 2843 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctccttwcacttttggcggagggaccaag

SEQ ID NO: 2844 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctccttwcacttttggcggagggaccaag

SEQ ID NO: 2845 - DNA, 75 bp, Artificial Sequence
  Description of Artificial Sequence: Synthetic oligonucleotide
cctgaagatattgcaacatattactgtswmcagtacgataatywccctccttwcacttttggcggagggaccaag

SEQ ID NO: 2846 - DNA, 75 bp, Artificial Sequence
  Description of Artificial Sequence: Synthetic oligonucleotide
cctgaagatattgcaacatattactgtcagswmbhcgataatctccctccttwcacttttggcggagggaccaag

SEQ ID NO: 2847 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctccttwcacttttggcggagggaccaag

SEQ ID NO: 2848 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctccttwcacttttggcggagggaccaag

SEQ ID NO: 2849 - DNA, 75 bp, Artificial Sequence
  Description of Artificial Sequence: Synthetic oligonucleotide
cctgaagatattgcaacatattactgtcagswmtacgataatywccctccttwcacttttggcggagggaccaag

SEQ ID NO: 2850 - DNA, 75 bp, Artificial Sequence
  Description of Artificial Sequence: Synthetic oligonucleotide
cctgaagatattgcaacatattactgtswmswmtacgataatctccctcctmtcacttttggcggagggaccaag

SEQ ID NO: 2851 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctcctmtcacttttggcggagggaccaag

SEQ ID NO: 2852 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctcctmtcacttttggcggagggaccaag

SEQ ID NO: 2853 - DNA, 75 bp, Artificial Sequence
  Description of Artificial Sequence: Synthetic oligonucleotide
cctgaagatattgcaacatattactgtcagcagbhcgataatywccctcctmtcacttttggcggagggaccaag

SEQ ID NO: 2854 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctcctmtcacttttggcggagggaccaag

SEQ ID NO: 2855 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctcctmtcacttttggcggagggaccaag

SEQ ID NO: 2856 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctcctmtcacttttggcggagggaccaag

SEQ ID NO: 2857 - DNA, 75 bp, Artificial Sequence
  Description of Artificial Sequence: Synthetic oligonucleotide
cctgaagatattgcaacatattactgtswmcagbhcgataatctccctcctmtcacttttggcggagggaccaag

SEQ ID NO: 2858 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctcctmtcacttttggcggagggaccaag

SEQ ID NO: 2859 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctcctmtcacttttggcggagggaccaag

SEQ ID NO: 2860 - DNA, 75 bp, Artificial Sequence
  Description of Artificial Sequence: Synthetic oligonucleotide
cctgaagatattgcaacatattactgtswmcagtacgataatywccctcctmtcacttttggcggagggaccaag

SEQ ID NO: 2861 - DNA, 75 bp, Artificial Sequence
  Description of Artificial Sequence: Synthetic oligonucleotide
cctgaagatattgcaacatattactgtcagswmbhcgataatctccctcctmtcacttttggcggagggaccaag

SEQ ID NO: 2862 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctcctmtcacttttggcggagggaccaag

SEQ ID NO: 2863 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctcctmtcacttttggcggagggaccaag

SEQ ID NO: 2864 - DNA, 75 bp, Artificial Sequence
  Description of Artificial Sequence: Synthetic oligonucleotide
cctgaagatattgcaacatattactgtcagswmtacgataatywccctcctmtcacttttggcggagggaccaag

SEQ ID NO: 2865 - DNA, 75 bp, Artificial Sequence
  Description of Artificial Sequence: Synthetic oligonucleotide
cctgaagatattgcaacatattactgtswmswmtacgataatctccctcctwggacttttggcggagggaccaag

SEQ ID NO: 2866 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatctccctcctwggacttttggcggagggaccaag

SEQ ID NO: 2867 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcctccctcctwggacttttggcggagggaccaag

SEQ ID NO: 2868 - DNA, 75 bp, Artificial Sequence
  Description of Artificial Sequence: Synthetic oligonucleotide
cctgaagatattgcaacatattactgtcagcagbhcgataatywccctcctwggacttttggcggagggaccaag

SEQ ID NO: 2869 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcctccctcctwggacttttggcggagggaccaag

SEQ ID NO: 2870 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagtacnhcaatywccctcctwggacttttggcggagggaccaag

SEQ ID NO: 2871 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagtacgatnhcywccctcctwggacttttggcggagggaccaag

SEQ ID NO: 2872 - DNA, 75 bp, Artificial Sequence
  Description of Artificial Sequence: Synthetic oligonucleotide
cctgaagatattgcaacatattactgtswmcagbhcgataatctccctcctwggacttttggcggagggaccaag

SEQ ID NO: 2873 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtswmcagtacnhcaatctccctcctwggacttttggcggagggaccaag

SEQ ID NO: 2874 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtswmcagtacgatnhcctccctcctwggacttttggcggagggaccaag

SEQ ID NO: 2875 - DNA, 75 bp, Artificial Sequence
  Description of Artificial Sequence: Synthetic oligonucleotide
cctgaagatattgcaacatattactgtswmcagtacgataatywccctcctwggacttttggcggagggaccaag

SEQ ID NO: 2876 - DNA, 75 bp, Artificial Sequence
  Description of Artificial Sequence: Synthetic oligonucleotide
cctgaagatattgcaacatattactgtcagswmbhcgataatctccctcctwggacttttggcggagggaccaag

SEQ ID NO: 2877 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagswmtacnhcaatctccctcctwggacttttggcggagggaccaag

SEQ ID NO: 2878 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagswmtacgatnhcctccctcctwggacttttggcggagggaccaag

SEQ ID NO: 2879 - DNA, 75 bp, Artificial Sequence
  Description of Artificial Sequence: Synthetic oligonucleotide
cctgaagatattgcaacatattactgtcagswmtacgataatywccctcctwggacttttggcggagggaccaag

SEQ ID NO: 2880 - DNA, 75 bp, Artificial Sequence
  Description of Artificial Sequence: Synthetic oligonucleotide
cctgaagattttgcaacttactactgtswmswmagctacagtactcctccttwcacttttggcggagggaccaag

SEQ ID NO: 2881 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctccttwcacttttggcggagggaccaag

SEQ ID NO: 2882 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctccttwcacttttggcggagggaccaag

SEQ ID NO: 2883 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctccttwcacttttggcggagggaccaag

SEQ ID NO: 2884 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctccttwcacttttggcggagggaccaag

SEQ ID NO: 2885 - DNA, 75 bp, Artificial Sequence
  Description of Artificial Sequence: Synthetic oligonucleotide
cctgaagattttgcaacttactactgtcagcaaagcbhcagtbhccctccttwcacttttggcggagggaccaag

SEQ ID NO: 2886 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctccttwcacttttggcggagggaccaag

SEQ ID NO: 2887 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctccttwcacttttggcggagggaccaag

SEQ ID NO: 2888 - DNA, 75 bp, Artificial Sequence
  Description of Artificial Sequence: Synthetic oligonucleotide
cctgaagattttgcaacttactactgtswmcaaagcbhcagtactcctccttwcacttttggcggagggaccaag

SEQ ID NO: 2889 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctccttwcacttttggcggagggaccaag

SEQ ID NO: 2890 - DNA, 75 bp, Artificial Sequence
  Description of Artificial Sequence: Synthetic oligonucleotide
cctgaagattttgcaacttactactgtswmcaaagctacagtbhccctccttwcacttttggcggagggaccaag

SEQ ID NO: 2891 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctccttwcacttttggcggagggaccaag

SEQ ID NO: 2892 - DNA, 75 bp, Artificial Sequence
  Description of Artificial Sequence: Synthetic oligonucleotide
cctgaagattttgcaacttactactgtcagswmagcbhcagtactcctccttwcacttttggcggagggaccaag

SEQ ID NO: 2893 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctccttwcacttttggcggagggaccaag

SEQ ID NO: 2894 - DNA, 75 bp, Artificial Sequence
  Description of Artificial Sequence: Synthetic oligonucleotide
cctgaagattttgcaacttactactgtcagswmagctacagtbhccctccttwcacttttggcggagggaccaag

SEQ ID NO: 2895 - DNA, 75 bp, Artificial Sequence
  Description of Artificial Sequence: Synthetic oligonucleotide
cctgaagattttgcaacttactactgtswmswmagctacagtactcctcctmtcacttttggcggagggaccaag

SEQ ID NO: 2896 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctcctmtcacttttggcggagggaccaag

SEQ ID NO: 2897 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctcctmtcacttttggcggagggaccaag

SEQ ID NO: 2898 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctcctmtcacttttggcggagggaccaag

SEQ ID NO: 2899 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctcctmtcacttttggcggagggaccaag

SEQ ID NO: 2900 - DNA, 75 bp, Artificial Sequence
  Description of Artificial Sequence: Synthetic oligonucleotide
cctgaagattttgcaacttactactgtcagcaaagcbhcagtbhccctcctmtcacttttggcggagggaccaag

SEQ ID NO: 2901 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctcctmtcacttttggcggagggaccaag

SEQ ID NO: 2902 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctcctmtcacttttggcggagggaccaag

SEQ ID NO: 2903 - DNA, 75 bp, Artificial Sequence
  Description of Artificial Sequence: Synthetic oligonucleotide
cctgaagattttgcaacttactactgtswmcaaagcbhcagtactcctcctmtcacttttggcggagggaccaag

SEQ ID NO: 2904 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctcctmtcacttttggcggagggaccaag

SEQ ID NO: 2905 - DNA, 75 bp, Artificial Sequence
  Description of Artificial Sequence: Synthetic oligonucleotide
cctgaagattttgcaacttactactgtswmcaaagctacagtbhccctcctmtcacttttggcggagggaccaag

SEQ ID NO: 2906 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctcctmtcacttttggcggagggaccaag

SEQ ID NO: 2907 - DNA, 75 bp, Artificial Sequence
  Description of Artificial Sequence: Synthetic oligonucleotide
cctgaagattttgcaacttactactgtcagswmagcbhcagtactcctcctmtcacttttggcggagggaccaag

SEQ ID NO: 2908 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctcctmtcacttttggcggagggaccaag

SEQ ID NO: 2909 - DNA, 75 bp, Artificial Sequence
  Description of Artificial Sequence: Synthetic oligonucleotide
cctgaagattttgcaacttactactgtcagswmagctacagtbhccctcctmtcacttttggcggagggaccaag

SEQ ID NO: 2910 - DNA, 75 bp, Artificial Sequence
  Description of Artificial Sequence: Synthetic oligonucleotide
cctgaagattttgcaacttactactgtswmswmagctacagtactcctcctwggacttttggcggagggaccaag

SEQ ID NO: 2911 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtactcctcctwggacttttggcggagggaccaag

SEQ ID NO: 2912 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcactcctcctwggacttttggcggagggaccaag

SEQ ID NO: 2913 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnatacagtbhccctcctwggacttttggcggagggaccaag

SEQ ID NO: 2914 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcactcctcctwggacttttggcggagggaccaag

SEQ ID NO: 2915 - DNA, 75 bp, Artificial Sequence
  Description of Artificial Sequence: Synthetic oligonucleotide
cctgaagattttgcaacttactactgtcagcaaagcbhcagtbhccctcctwggacttttggcggagggaccaag

SEQ ID NO: 2916 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagctacnhcbhccctcctwggacttttggcggagggaccaag

SEQ ID NO: 2917 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtswmcaavnatacagtactcctcctwggacttttggcggagggaccaag

SEQ ID NO: 2918 - DNA, 75 bp, Artificial Sequence
  Description of Artificial Sequence: Synthetic oligonucleotide
cctgaagattttgcaacttactactgtswmcaaagcbhcagtactcctcctwggacttttggcggagggaccaag

SEQ ID NO: 2919 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtswmcaaagctacnhcactcctcctwggacttttggcggagggaccaag

SEQ ID NO: 2920 - DNA, 75 bp, Artificial Sequence
  Description of Artificial Sequence: Synthetic oligonucleotide
cctgaagattttgcaacttactactgtswmcaaagctacagtbhccctcctwggacttttggcggagggaccaag

SEQ ID NO: 2921 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagswmvnatacagtactcctcctwggacttttggcggagggaccaag

SEQ ID NO: 2922 - DNA, 75 bp, Artificial Sequence
  Description of Artificial Sequence: Synthetic oligonucleotide
cctgaagattttgcaacttactactgtcagswmagcbhcagtactcctcctwggacttttggcggagggaccaag

SEQ ID NO: 2923 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagswmagctacnhcactcctcctwggacttttggcggagggaccaag

SEQ ID NO: 2924 - DNA, 75 bp, Artificial Sequence
  Description of Artificial Sequence: Synthetic oligonucleotide
cctgaagattttgcaacttactactgtcagswmagctacagtbhccctcctwggacttttggcggagggaccaag

SEQ ID NO: 2925 - DNA, 75 bp, Artificial Sequence
  Description of Artificial Sequence: Synthetic oligonucleotide
gctgaggatgttggggtttattactgcdtsswmgcactccagactcctccttwcacttttggcggagggaccaag

SEQ ID NO: 2926 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctccttwcacttttggcggagggaccaag

SEQ ID NO: 2927 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctccttwcacttttggcggagggaccaag

SEQ ID NO: 2928 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctccttwcacttttggcggagggaccaag

SEQ ID NO: 2929 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctccttwcacttttggcggagggaccaag

SEQ ID NO: 2930 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctccttwcacttttggcggagggaccaag

SEQ ID NO: 2931 - DNA, 75 bp, Artificial Sequence
  Description of Artificial Sequence: Synthetic oligonucleotide
gctgaggatgttggggtttattactgcatgcaggcactcsrmvbccctccttwcacttttggcggagggaccaag

SEQ ID NO: 2932 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctccttwcacttttggcggagggaccaag

SEQ ID NO: 2933 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctccttwcacttttggcggagggaccaag

SEQ ID NO: 2934 - DNA, 75 bp, Artificial Sequence
  Description of Artificial Sequence: Synthetic oligonucleotide
gctgaggatgttggggtttattactgcdtscaggcactcsrmactcctccttwcacttttggcggagggaccaag

SEQ ID NO: 2935 - DNA, 75 bp, Artificial Sequence
  Description of Artificial Sequence: Synthetic oligonucleotide
gctgaggatgttggggtttattactgcdtscaggcactccagvbccctccttwcacttttggcggagggaccaag

SEQ ID NO: 2936 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctccttwcacttttggcggagggaccaag

SEQ ID NO: 2937 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctccttwcacttttggcggagggaccaag

SEQ ID NO: 2938 - DNA, 75 bp, Artificial Sequence
  Description of Artificial Sequence: Synthetic oligonucleotide
gctgaggatgttggggtttattactgcatgswmgcactcsrmactcctccttwcacttttggcggagggaccaag

SEQ ID NO: 2939 - DNA, 75 bp, Artificial Sequence
  Description of Artificial Sequence: Synthetic oligonucleotide
gctgaggatgttggggtttattactgcatgswmgcactccagvbccctccttwcacttttggcggagggaccaag

SEQ ID NO: 2940 - DNA, 75 bp, Artificial Sequence
  Description of Artificial Sequence: Synthetic oligonucleotide
gctgaggatgttggggtttattactgcdtsswmgcactccagactcctcctmtcacttttggcggagggaccaag

SEQ ID NO: 2941 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctcctmtcacttttggcggagggaccaag

SEQ ID NO: 2942 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctcctmtcacttttggcggagggaccaag

SEQ ID NO: 2943 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctcctmtcacttttggcggagggaccaag

SEQ ID NO: 2944 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctcctmtcacttttggcggagggaccaag

SEQ ID NO: 2945 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctcctmtcacttttggcggagggaccaag

SEQ ID NO: 2946 - DNA, 75 bp, Artificial Sequence
  Description of Artificial Sequence: Synthetic oligonucleotide
gctgaggatgttggggtttattactgcatgcaggcactcsrmvbccctcctmtcacttttggcggagggaccaag

SEQ ID NO: 2947 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctcctmtcacttttggcggagggaccaag

SEQ ID NO: 2948 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctcctmtcacttttggcggagggaccaag

SEQ ID NO: 2949 - DNA, 75 bp, Artificial Sequence
  Description of Artificial Sequence: Synthetic oligonucleotide
gctgaggatgttggggtttattactgcdtscaggcactcsrmactcctcctmtcacttttggcggagggaccaag

SEQ ID NO: 2950 - DNA, 75 bp, Artificial Sequence
  Description of Artificial Sequence: Synthetic oligonucleotide
gctgaggatgttggggtttattactgcdtscaggcactccagvbccctcctmtcacttttggcggagggaccaag

SEQ ID NO: 2951 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctcctmtcacttttggcggagggaccaag

SEQ ID NO: 2952 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctcctmtcacttttggcggagggaccaag

SEQ ID NO: 2953 - DNA, 75 bp, Artificial Sequence
  Description of Artificial Sequence: Synthetic oligonucleotide
gctgaggatgttggggtttattactgcatgswmgcactcsrmactcctcctmtcacttttggcggagggaccaag

SEQ ID NO: 2954 - DNA, 75 bp, Artificial Sequence
  Description of Artificial Sequence: Synthetic oligonucleotide
gctgaggatgttggggtttattactgcatgswmgcactccagvbccctcctmtcacttttggcggagggaccaag

SEQ ID NO: 2955 - DNA, 75 bp, Artificial Sequence
  Description of Artificial Sequence: Synthetic oligonucleotide
gctgaggatgttggggtttattactgcdtsswmgcactccagactcctcctwggacttttggcggagggaccaag

SEQ ID NO: 2956 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagactcctcctwggacttttggcggagggaccaag

SEQ ID NO: 2957 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmactcctcctwggacttttggcggagggaccaag

SEQ ID NO: 2958 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactccagvbccctcctwggacttttggcggagggaccaag

SEQ ID NO: 2959 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmactcctcctwggacttttggcggagggaccaag

SEQ ID NO: 2960 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnacagvbccctcctwggacttttggcggagggaccaag

SEQ ID NO: 2961 - DNA, 75 bp, Artificial Sequence
  Description of Artificial Sequence: Synthetic oligonucleotide
gctgaggatgttggggtttattactgcatgcaggcactcsrmvbccctcctwggacttttggcggagggaccaag

SEQ ID NO: 2962 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcdtscagvnactccagactcctcctwggacttttggcggagggaccaag

SEQ ID NO: 2963 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcdtscaggcamnacagactcctcctwggacttttggcggagggaccaag

SEQ ID NO: 2964 - DNA, 75 bp, Artificial Sequence
  Description of Artificial Sequence: Synthetic oligonucleotide
gctgaggatgttggggtttattactgcdtscaggcactcsrmactcctcctwggacttttggcggagggaccaag

SEQ ID NO: 2965 - DNA, 75 bp, Artificial Sequence
  Description of Artificial Sequence: Synthetic oligonucleotide
gctgaggatgttggggtttattactgcdtscaggcactccagvbccctcctwggacttttggcggagggaccaag

SEQ ID NO: 2966 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgswmvnactccagactcctcctwggacttttggcggagggaccaag

SEQ ID NO: 2967 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgswmgcamnacagactcctcctwggacttttggcggagggaccaag

SEQ ID NO: 2968 - DNA, 75 bp, Artificial Sequence
  Description of Artificial Sequence: Synthetic oligonucleotide
gctgaggatgttggggtttattactgcatgswmgcactcsrmactcctcctwggacttttggcggagggaccaag

SEQ ID NO: 2969 - DNA, 75 bp, Artificial Sequence
  Description of Artificial Sequence: Synthetic oligonucleotide
gctgaggatgttggggtttattactgcatgswmgcactccagvbccctcctwggacttttggcggagggaccaag

SEQ ID NO: 2970 - DNA, 75 bp, Artificial Sequence
  Description of Artificial Sequence: Synthetic oligonucleotide
cctgaagattttgcagtttattactgtswmswmagaagtaattggcctccttwcacttttggcggagggaccaag

SEQ ID NO: 2971 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctccttwcacttttggcggagggaccaag

SEQ ID NO: 2972 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctccttwcacttttggcggagggaccaag

SEQ ID NO: 2973 - DNA, 75 bp, Artificial Sequence
  Description of Artificial Sequence: Synthetic oligonucleotide
cctgaagattttgcagtttattactgtcagcagbhcagtaatywccctccttwcacttttggcggagggaccaag

SEQ ID NO: 2974 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctccttwcacttttggcggagggaccaag

SEQ ID NO: 2975 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctccttwcacttttggcggagggaccaag

SEQ ID NO: 2976 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctccttwcacttttggcggagggaccaag

SEQ ID NO: 2977 - DNA, 75 bp, Artificial Sequence
  Description of Artificial Sequence: Synthetic oligonucleotide
cctgaagattttgcagtttattactgtswmcagbhcagtaattggcctccttwcacttttggcggagggaccaag

SEQ ID NO: 2978 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctccttwcacttttggcggagggaccaag

SEQ ID NO: 2979 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctccttwcacttttggcggagggaccaag

SEQ ID NO: 2980 - DNA, 75 bp, Artificial Sequence
  Description of Artificial Sequence: Synthetic oligonucleotide
cctgaagattttgcagtttattactgtswmcagagaagtaatywccctccttwcacttttggcggagggaccaag

SEQ ID NO: 2981 - DNA, 75 bp, Artificial Sequence
  Description of Artificial Sequence: Synthetic oligonucleotide
cctgaagattttgcagtttattactgtcagswmbhcagtaattggcctccttwcacttttggcggagggaccaag

SEQ ID NO: 2982 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctccttwcacttttggcggagggaccaag

SEQ ID NO: 2983 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctccttwcacttttggcggagggaccaag

SEQ ID NO: 2984 - DNA, 75 bp, Artificial Sequence
  Description of Artificial Sequence: Synthetic oligonucleotide
cctgaagattttgcagtttattactgtcagswmagaagtaatywccctccttwcacttttggcggagggaccaag

SEQ ID NO: 2985 - DNA, 75 bp, Artificial Sequence
  Description of Artificial Sequence: Synthetic oligonucleotide
cctgaagattttgcagtttattactgtswmswmagaagtaattggcctcctmtcacttttggcggagggaccaag

SEQ ID NO: 2986 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctcctmtcacttttggcggagggaccaag

SEQ ID NO: 2987 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctcctmtcacttttggcggagggaccaag

SEQ ID NO: 2988 - DNA, 75 bp, Artificial Sequence
  Description of Artificial Sequence: Synthetic oligonucleotide
cctgaagattttgcagtttattactgtcagcagbhcagtaatywccctcctmtcacttttggcggagggaccaag

SEQ ID NO: 2989 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctcctmtcacttttggcggagggaccaag

SEQ ID NO: 2990 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctcctmtcacttttggcggagggaccaag

SEQ ID NO: 2991 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctcctmtcacttttggcggagggaccaag

SEQ ID NO: 2992 - DNA, 75 bp, Artificial Sequence
  Description of Artificial Sequence: Synthetic oligonucleotide
cctgaagattttgcagtttattactgtswmcagbhcagtaattggcctcctmtcacttttggcggagggaccaag

SEQ ID NO: 2993 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctcctmtcacttttggcggagggaccaag

SEQ ID NO: 2994 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctcctmtcacttttggcggagggaccaag

SEQ ID NO: 2995 - DNA, 75 bp, Artificial Sequence
  Description of Artificial Sequence: Synthetic oligonucleotide
cctgaagattttgcagtttattactgtswmcagagaagtaatywccctcctmtcacttttggcggagggaccaag

SEQ ID NO: 2996 - DNA, 75 bp, Artificial Sequence
  Description of Artificial Sequence: Synthetic oligonucleotide
cctgaagattttgcagtttattactgtcagswmbhcagtaattggcctcctmtcacttttggcggagggaccaag

SEQ ID NO: 2997 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctcctmtcacttttggcggagggaccaag

SEQ ID NO: 2998 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctcctmtcacttttggcggagggaccaag

SEQ ID NO: 2999 - DNA, 75 bp, Artificial Sequence
  Description of Artificial Sequence: Synthetic oligonucleotide
cctgaagattttgcagtttattactgtcagswmagaagtaatywccctcctmtcacttttggcggagggaccaag

SEQ ID NO: 3000 - DNA, 75 bp, Artificial Sequence
  Description of Artificial Sequence: Synthetic oligonucleotide
cctgaagattttgcagtttattactgtswmswmagaagtaattggcctcctwggacttttggcggagggaccaag

SEQ ID NO: 3001 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaattggcctcctwggacttttggcggagggaccaag

SEQ ID NO: 3002 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhctggcctcctwggacttttggcggagggaccaag

SEQ ID NO: 3003 - DNA, 75 bp, Artificial Sequence
  Description of Artificial Sequence: Synthetic oligonucleotide
cctgaagattttgcagtttattactgtcagcagbhcagtaatywccctcctwggacttttggcggagggaccaag

SEQ ID NO: 3004 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhctggcctcctwggacttttggcggagggaccaag

SEQ ID NO: 3005 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagaganhcaatywccctcctwggacttttggcggagggaccaag

SEQ ID NO: 3006 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagagaagtnhcywccctcctwggacttttggcggagggaccaag

SEQ ID NO: 3007 - DNA, 75 bp, Artificial Sequence
  Description of Artificial Sequence: Synthetic oligonucleotide
cctgaagattttgcagtttattactgtswmcagbhcagtaattggcctcctwggacttttggcggagggaccaag

SEQ ID NO: 3008 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtswmcagaganhcaattggcctcctwggacttttggcggagggaccaag

SEQ ID NO: 3009 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtswmcagagaagtnhctggcctcctwggacttttggcggagggaccaag

SEQ ID NO: 3010 - DNA, 75 bp, Artificial Sequence
  Description of Artificial Sequence: Synthetic oligonucleotide
cctgaagattttgcagtttattactgtswmcagagaagtaatywccctcctwggacttttggcggagggaccaag

SEQ ID NO: 3011 - DNA, 75 bp, Artificial Sequence
  Description of Artificial Sequence: Synthetic oligonucleotide
cctgaagattttgcagtttattactgtcagswmbhcagtaattggcctcctwggacttttggcggagggaccaag

SEQ ID NO: 3012 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagswmaganhcaattggcctcctwggacttttggcggagggaccaag

SEQ ID NO: 3013 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagswmagaagtnhctggcctcctwggacttttggcggagggaccaag

SEQ ID NO: 3014 - DNA, 75 bp, Artificial Sequence
  Description of Artificial Sequence: Synthetic oligonucleotide
cctgaagattttgcagtttattactgtcagswmagaagtaatywccctcctwggacttttggcggagggaccaag

SEQ ID NO: 3015 - DNA, 78 bp, Artificial Sequence
  Description of Artificial Sequence: Synthetic oligonucleotide
cagtctgaagattttgcagtttattactgtswmswmtacaataattggcctccttwcacttttggcggagggaccaag

SEQ ID NO: 3016 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctccttwcacttttggcggagggaccaag

SEQ ID NO: 3017 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctccttwcacttttggcggagggaccaag

SEQ ID NO: 3018 - DNA, 78 bp, Artificial Sequence
  Description of Artificial Sequence: Synthetic oligonucleotide
cagtctgaagattttgcagtttattactgtcagcagbhcaataatywccctccttwcacttttggcggagggaccaag

SEQ ID NO: 3019 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctccttwcacttttggcggagggaccaag

SEQ ID NO: 3020 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctccttwcacttttggcggagggaccaag

SEQ ID NO: 3021 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctccttwcacttttggcggagggaccaag

SEQ ID NO: 3022 - DNA, 78 bp, Artificial Sequence
  Description of Artificial Sequence: Synthetic oligonucleotide
cagtctgaagattttgcagtttattactgtswmcagbhcaataattggcctccttwcacttttggcggagggaccaag

SEQ ID NO: 3023 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctccttwcacttttggcggagggaccaag

SEQ ID NO: 3024 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctccttwcacttttggcggagggaccaag

SEQ ID NO: 3025 - DNA, 78 bp, Artificial Sequence
  Description of Artificial Sequence: Synthetic oligonucleotide
cagtctgaagattttgcagtttattactgtswmcagtacaataatywccctccttwcacttttggcggagggaccaag

SEQ ID NO: 3026 - DNA, 78 bp, Artificial Sequence
  Description of Artificial Sequence: Synthetic oligonucleotide
cagtctgaagattttgcagtttattactgtcagswmbhcaataattggcctccttwcacttttggcggagggaccaag

SEQ ID NO: 3027 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctccttwcacttttggcggagggaccaag

SEQ ID NO: 3028 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctccttwcacttttggcggagggaccaag

SEQ ID NO: 3029 - DNA, 78 bp, Artificial Sequence
  Description of Artificial Sequence: Synthetic oligonucleotide
cagtctgaagattttgcagtttattactgtcagswmtacaataatywccctccttwcacttttggcggagggaccaag

SEQ ID NO: 3030 - DNA, 78 bp, Artificial Sequence
  Description of Artificial Sequence: Synthetic oligonucleotide
cagtctgaagattttgcagtttattactgtswmswmtacaataattggcctcctmtcacttttggcggagggaccaag

SEQ ID NO: 3031 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctcctmtcacttttggcggagggaccaag

SEQ ID NO: 3032 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctcctmtcacttttggcggagggaccaag

SEQ ID NO: 3033 - DNA, 78 bp, Artificial Sequence
  Description of Artificial Sequence: Synthetic oligonucleotide
cagtctgaagattttgcagtttattactgtcagcagbhcaataatywccctcctmtcacttttggcggagggaccaag

SEQ ID NO: 3034 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctcctmtcacttttggcggagggaccaag

SEQ ID NO: 3035 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctcctmtcacttttggcggagggaccaag

SEQ ID NO: 3036 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctcctmtcacttttggcggagggaccaag

SEQ ID NO: 3037 - DNA, 78 bp, Artificial Sequence
  Description of Artificial Sequence: Synthetic oligonucleotide
cagtctgaagattttgcagtttattactgtswmcagbhcaataattggcctcctmtcacttttggcggagggaccaag

SEQ ID NO: 3038 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctcctmtcacttttggcggagggaccaag

SEQ ID NO: 3039 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctcctmtcacttttggcggagggaccaag

SEQ ID NO: 3040 - DNA, 78 bp, Artificial Sequence
  Description of Artificial Sequence: Synthetic oligonucleotide
cagtctgaagattttgcagtttattactgtswmcagtacaataatywccctcctmtcacttttggcggagggaccaag

SEQ ID NO: 3041 - DNA, 78 bp, Artificial Sequence
  Description of Artificial Sequence: Synthetic oligonucleotide
cagtctgaagattttgcagtttattactgtcagswmbhcaataattggcctcctmtcacttttggcggagggaccaag

SEQ ID NO: 3042 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctcctmtcacttttggcggagggaccaag

SEQ ID NO: 3043 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctcctmtcacttttggcggagggaccaag

SEQ ID NO: 3044 - DNA, 78 bp, Artificial Sequence
  Description of Artificial Sequence: Synthetic oligonucleotide
cagtctgaagattttgcagtttattactgtcagswmtacaataatywccctcctmtcacttttggcggagggaccaag

SEQ ID NO: 3045 - DNA, 78 bp, Artificial Sequence
  Description of Artificial Sequence: Synthetic oligonucleotide
cagtctgaagattttgcagtttattactgtswmswmtacaataattggcctcctwggacttttggcggagggaccaag

SEQ ID NO: 3046 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaattggcctcctwggacttttggcggagggaccaag

SEQ ID NO: 3047 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhctggcctcctwggacttttggcggagggaccaag

SEQ ID NO: 3048 - DNA, 78 bp, Artificial Sequence
  Description of Artificial Sequence: Synthetic oligonucleotide
cagtctgaagattttgcagtttattactgtcagcagbhcaataatywccctcctwggacttttggcggagggaccaag

SEQ ID NO: 3049 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhctggcctcctwggacttttggcggagggaccaag

SEQ ID NO: 3050 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagtacnhcaatywccctcctwggacttttggcggagggaccaag

SEQ ID NO: 3051 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagtacaatnhcywccctcctwggacttttggcggagggaccaag

SEQ ID NO: 3052 - DNA, 78 bp, Artificial Sequence
  Description of Artificial Sequence: Synthetic oligonucleotide
cagtctgaagattttgcagtttattactgtswmcagbhcaataattggcctcctwggacttttggcggagggaccaag

SEQ ID NO: 3053 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtswmcagtacnhcaattggcctcctwggacttttggcggagggaccaag

SEQ ID NO: 3054 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtswmcagtacaatnhctggcctcctwggacttttggcggagggaccaag

SEQ ID NO: 3055 - DNA, 78 bp, Artificial Sequence
  Description of Artificial Sequence: Synthetic oligonucleotide
cagtctgaagattttgcagtttattactgtswmcagtacaataatywccctcctwggacttttggcggagggaccaag

SEQ ID NO: 3056 - DNA, 78 bp, Artificial Sequence
  Description of Artificial Sequence: Synthetic oligonucleotide
cagtctgaagattttgcagtttattactgtcagswmbhcaataattggcctcctwggacttttggcggagggaccaag

SEQ ID NO: 3057 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagswmtacnhcaattggcctcctwggacttttggcggagggaccaag

SEQ ID NO: 3058 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagswmtacaatnhctggcctcctwggacttttggcggagggaccaag

SEQ ID NO: 3059 - DNA, 78 bp, Artificial Sequence
  Description of Artificial Sequence: Synthetic oligonucleotide
cagtctgaagattttgcagtttattactgtcagswmtacaataatywccctcctwggacttttggcggagggaccaag

SEQ ID NO: 3060 - DNA, 75 bp, Artificial Sequence
  Description of Artificial Sequence: Synthetic oligonucleotide
cctgaagattttgcagtgtattactgtswmswmtacggaagtagtcctccttwcacttttggcggagggaccaag

SEQ ID NO: 3061 - DNA, 75 bp, Artificial Sequence
  Description of Artificial Sequence: Synthetic oligonucleotide
cctgaagattttgcagtgtattactgtcagcagbhcbhcagtagtcctccttwcacttttggcggagggaccaag

SEQ ID NO: 3062 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctccttwcacttttggcggagggaccaag

SEQ ID NO: 3063 - DNA, 75 bp, Artificial Sequence
  Description of Artificial Sequence: Synthetic oligonucleotide
cctgaagattttgcagtgtattactgtcagcagbhcggaagtbhccctccttwcacttttggcggagggaccaag

SEQ ID NO: 3064 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctccttwcacttttggcggagggaccaag

SEQ ID NO: 3065 - DNA, 75 bp, Artificial Sequence
  Description of Artificial Sequence: Synthetic oligonucleotide
cctgaagattttgcagtgtattactgtcagcagtacbhcagtbhccctccttwcacttttggcggagggaccaag

SEQ ID NO: 3066 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctccttwcacttttggcggagggaccaag

SEQ ID NO: 3067 - DNA, 75 bp, Artificial Sequence
  Description of Artificial Sequence: Synthetic oligonucleotide
cctgaagattttgcagtgtattactgtswmcagbhcggaagtagtcctccttwcacttttggcggagggaccaag

SEQ ID NO: 3068 - DNA, 75 bp, Artificial Sequence
  Description of Artificial Sequence: Synthetic oligonucleotide
cctgaagattttgcagtgtattactgtswmcagtacbhcagtagtcctccttwcacttttggcggagggaccaag

SEQ ID NO: 3069 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctccttwcacttttggcggagggaccaag

SEQ ID NO: 3070 - DNA, 75 bp, Artificial Sequence
  Description of Artificial Sequence: Synthetic oligonucleotide
cctgaagattttgcagtgtattactgtswmcagtacggaagtbhccctccttwcacttttggcggagggaccaag

SEQ ID NO: 3071 - DNA, 75 bp, Artificial Sequence
  Description of Artificial Sequence: Synthetic oligonucleotide
cctgaagattttgcagtgtattactgtcagswmbhcggaagtagtcctccttwcacttttggcggagggaccaag

SEQ ID NO: 3072 - DNA, 75 bp, Artificial Sequence
  Description of Artificial Sequence: Synthetic oligonucleotide
cctgaagattttgcagtgtattactgtcagswmtacbhcagtagtcctccttwcacttttggcggagggaccaag

SEQ ID NO: 3073 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctccttwcacttttggcggagggaccaag

SEQ ID NO: 3074 - DNA, 75 bp, Artificial Sequence
  Description of Artificial Sequence: Synthetic oligonucleotide
cctgaagattttgcagtgtattactgtcagswmtacggaagtbhccctccttwcacttttggcggagggaccaag

SEQ ID NO: 3075 - DNA, 75 bp, Artificial Sequence
  Description of Artificial Sequence: Synthetic oligonucleotide
cctgaagattttgcagtgtattactgtswmswmtacggaagtagtcctcctmtcacttttggcggagggaccaag

SEQ ID NO: 3076 - DNA, 75 bp, Artificial Sequence
  Description of Artificial Sequence: Synthetic oligonucleotide
cctgaagattttgcagtgtattactgtcagcagbhcbhcagtagtcctcctmtcacttttggcggagggaccaag

SEQ ID NO: 3077 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctcctmtcacttttggcggagggaccaag

SEQ ID NO: 3078 - DNA, 75 bp, Artificial Sequence
  Description of Artificial Sequence: Synthetic oligonucleotide
cctgaagattttgcagtgtattactgtcagcagbhcggaagtbhccctcctmtcacttttggcggagggaccaag

SEQ ID NO: 3079 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctcctmtcacttttggcggagggaccaag

SEQ ID NO: 3080 - DNA, 75 bp, Artificial Sequence
  Description of Artificial Sequence: Synthetic oligonucleotide
cctgaagattttgcagtgtattactgtcagcagtacbhcagtbhccctcctmtcacttttggcggagggaccaag

SEQ ID NO: 3081 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctcctmtcacttttggcggagggaccaag

SEQ ID NO: 3082 - DNA, 75 bp, Artificial Sequence
  Description of Artificial Sequence: Synthetic oligonucleotide
cctgaagattttgcagtgtattactgtswmcagbhcggaagtagtcctcctmtcacttttggcggagggaccaag

SEQ ID NO: 3083 - DNA, 75 bp, Artificial Sequence
  Description of Artificial Sequence: Synthetic oligonucleotide
cctgaagattttgcagtgtattactgtswmcagtacbhcagtagtcctcctmtcacttttggcggagggaccaag

SEQ ID NO: 3084 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctcctmtcacttttggcggagggaccaag

SEQ ID NO: 3085 - DNA, 75 bp, Artificial Sequence
  Description of Artificial Sequence: Synthetic oligonucleotide
cctgaagattttgcagtgtattactgtswmcagtacggaagtbhccctcctmtcacttttggcggagggaccaag

SEQ ID NO: 3086 - DNA, 75 bp, Artificial Sequence
  Description of Artificial Sequence: Synthetic oligonucleotide
cctgaagattttgcagtgtattactgtcagswmbhcggaagtagtcctcctmtcacttttggcggagggaccaag

SEQ ID NO: 3087 - DNA, 75 bp, Artificial Sequence
  Description of Artificial Sequence: Synthetic oligonucleotide
cctgaagattttgcagtgtattactgtcagswmtacbhcagtagtcctcctmtcacttttggcggagggaccaag

SEQ ID NO: 3088 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctcctmtcacttttggcggagggaccaag

SEQ ID NO: 3089 - DNA, 75 bp, Artificial Sequence
  Description of Artificial Sequence: Synthetic oligonucleotide
cctgaagattttgcagtgtattactgtcagswmtacggaagtbhccctcctmtcacttttggcggagggaccaag

SEQ ID NO: 3090 - DNA, 75 bp, Artificial Sequence
  Description of Artificial Sequence: Synthetic oligonucleotide
cctgaagattttgcagtgtattactgtswmswmtacggaagtagtcctcctwggacttttggcggagggaccaag

SEQ ID NO: 3091 - DNA, 75 bp, Artificial Sequence
  Description of Artificial Sequence: Synthetic oligonucleotide
cctgaagattttgcagtgtattactgtcagcagbhcbhcagtagtcctcctwggacttttggcggagggaccaag

SEQ ID NO: 3092 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncagtcctcctwggacttttggcggagggaccaag

SEQ ID NO: 3093 - DNA, 75 bp, Artificial Sequence
  Description of Artificial Sequence: Synthetic oligonucleotide
cctgaagattttgcagtgtattactgtcagcagbhcggaagtbhccctcctwggacttttggcggagggaccaag

SEQ ID NO: 3094 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncagtcctcctwggacttttggcggagggaccaag

SEQ ID NO: 3095 - DNA, 75 bp, Artificial Sequence
  Description of Artificial Sequence: Synthetic oligonucleotide
cctgaagattttgcagtgtattactgtcagcagtacbhcagtbhccctcctwggacttttggcggagggaccaag

SEQ ID NO: 3096 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacggavncbhccctcctwggacttttggcggagggaccaag

SEQ ID NO: 3097 - DNA, 75 bp, Artificial Sequence
  Description of Artificial Sequence: Synthetic oligonucleotide
cctgaagattttgcagtgtattactgtswmcagbhcggaagtagtcctcctwggacttttggcggagggaccaag

SEQ ID NO: 3098 - DNA, 75 bp, Artificial Sequence
  Description of Artificial Sequence: Synthetic oligonucleotide
cctgaagattttgcagtgtattactgtswmcagtacbhcagtagtcctcctwggacttttggcggagggaccaag

SEQ ID NO: 3099 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtswmcagtacggavncagtcctcctwggacttttggcggagggaccaag

SEQ ID NO: 3100 - DNA, 75 bp, Artificial Sequence
  Description of Artificial Sequence: Synthetic oligonucleotide
cctgaagattttgcagtgtattactgtswmcagtacggaagtbhccctcctwggacttttggcggagggaccaag

SEQ ID NO: 3101 - DNA, 75 bp, Artificial Sequence
  Description of Artificial Sequence: Synthetic oligonucleotide
cctgaagattttgcagtgtattactgtcagswmbhcggaagtagtcctcctwggacttttggcggagggaccaag

SEQ ID NO: 3102 - DNA, 75 bp, Artificial Sequence
  Description of Artificial Sequence: Synthetic oligonucleotide
cctgaagattttgcagtgtattactgtcagswmtacbhcagtagtcctcctwggacttttggcggagggaccaag

SEQ ID NO: 3103 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagswmtacggavncagtcctcctwggacttttggcggagggaccaag

SEQ ID NO: 3104 - DNA, 75 bp, Artificial Sequence
  Description of Artificial Sequence: Synthetic oligonucleotide
cctgaagattttgcagtgtattactgtcagswmtacggaagtbhccctcctwggacttttggcggagggaccaag

SEQ ID NO: 3105 - DNA, 75 bp, Artificial Sequence
  Description of Artificial Sequence: Synthetic oligonucleotide
cctgatgattttgcaacttattactgccagcagbhcvrmmbctacyctccttwcacttttggcggagggaccaag

SEQ ID NO: 3106 - DNA, 75 bp, Artificial Sequence
  Description of Artificial Sequence: Synthetic oligonucleotide
cctgatgattttgcaacttattactgccagcagbhcvrmmbctacyctcctmtcacttttggcggagggaccaag

SEQ ID NO: 3107 - DNA, 75 bp, Artificial Sequence
  Description of Artificial Sequence: Synthetic oligonucleotide
cctgatgattttgcaacttattactgccagcagbhcvrmmbctacyctcctwggacttttggcggagggaccaag

SEQ ID NO: 3108 - DNA, 75 bp, Artificial Sequence
  Description of Artificial Sequence: Synthetic oligonucleotide
cctgatgattttgcaacttattactgccagcagbhcaatmbcywcyctccttwcacttttggcggagggaccaag

SEQ ID NO: 3109 - DNA, 75 bp, Artificial Sequence
  Description of Artificial Sequence: Synthetic oligonucleotide
cctgatgattttgcaacttattactgccagcagbhcaatmbcywcyctcctmtcacttttggcggagggaccaag

SEQ ID NO: 3110 - DNA, 75 bp, Artificial Sequence
  Description of Artificial Sequence: Synthetic oligonucleotide
cctgatgattttgcaacttattactgccagcagbhcaatmbcywcyctcctwggacttttggcggagggaccaag

SEQ ID NO: 3111 - DNA, 75 bp, Artificial Sequence
  Description of Artificial Sequence: Synthetic oligonucleotide
cctgatgattttgcaacttattactgccagcagbhcvrmagtywcyctccttwcacttttggcggagggaccaag

SEQ ID NO: 3112 - DNA, 75 bp, Artificial Sequence
  Description of Artificial Sequence: Synthetic oligonucleotide
cctgatgattttgcaacttattactgccagcagbhcvrmagtywcyctcctmtcacttttggcggagggaccaag

SEQ ID NO: 3113 - DNA, 75 bp, Artificial Sequence
  Description of Artificial Sequence: Synthetic oligonucleotide
cctgatgattttgcaacttattactgccagcagbhcvrmagtywcyctcctwggacttttggcggagggaccaag

SEQ ID NO: 3114 - DNA, 75 bp, Artificial Sequence
  Description of Artificial Sequence: Synthetic oligonucleotide
cctgatgattttgcaacttattactgccagcagtacvrmmbcywcyctccttwcacttttggcggagggaccaag

SEQ ID NO: 3115 - DNA, 75 bp, Artificial Sequence
  Description of Artificial Sequence: Synthetic oligonucleotide
cctgatgattttgcaacttattactgccagcagtacvrmmbcywcyctcctmtcacttttggcggagggaccaag

SEQ ID NO: 3116 - DNA, 75 bp, Artificial Sequence
  Description of Artificial Sequence: Synthetic oligonucleotide
cctgatgattttgcaacttattactgccagcagtacvrmmbcywcyctcctwggacttttggcggagggaccaag

SEQ ID NO: 3117 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctccttwcacttttggcggagggaccaag

SEQ ID NO: 3118 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctcctmtcacttttggcggagggaccaag

SEQ ID NO: 3119 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcagrnanhcnhcttccctcctwggacttttggcggagggaccaag

SEQ ID NO: 3120 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctccttwcacttttggcggagggaccaag

SEQ ID NO: 3121 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctcctmtcacttttggcggagggaccaag

SEQ ID NO: 3122 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (37)..(37): a, c, t or g
  misc_feature (37)..(37): n is a, c, g, or t
cctgaagattttgcaacttattactgtcagcagrnanhcagtywccctcctwggacttttggcggagggaccaag

SEQ ID NO: 3123 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctccttwcacttttggcggagggaccaag

SEQ ID NO: 3124 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctcctmtcacttttggcggagggaccaag

SEQ ID NO: 3125 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttattactgtcagcagrnaaatnhcywccctcctwggacttttggcggagggaccaag

SEQ ID NO: 3126 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctccttwcacttttggcggagggaccaag

SEQ ID NO: 3127 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctcctmtcacttttggcggagggaccaag

SEQ ID NO: 3128 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcaacttattactgtcagcaggcanhcnhcywccctcctwggacttttggcggagggaccaag

SEQ ID NO: 3129 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctccttwcacttttggcggagggaccaag

SEQ ID NO: 3130 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctcctmtcacttttggcggagggaccaag

SEQ ID NO: 3131 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagbhcnhcnhcctccctcctwggacttttggcggagggaccaag

SEQ ID NO: 3132 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctccttwcacttttggcggagggaccaag

SEQ ID NO: 3133 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctcctmtcacttttggcggagggaccaag

SEQ ID NO: 3134 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagatattgcaacatattactgtcagcagbhcnhcaatywccctcctwggacttttggcggagggaccaag

SEQ ID NO: 3135 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctccttwcacttttggcggagggaccaag

SEQ ID NO: 3136 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctcctmtcacttttggcggagggaccaag

SEQ ID NO: 3137 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagatattgcaacatattactgtcagcagbhcgatnhcywccctcctwggacttttggcggagggaccaag

SEQ ID NO: 3138 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctccttwcacttttggcggagggaccaag

SEQ ID NO: 3139 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctcctmtcacttttggcggagggaccaag

SEQ ID NO: 3140 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagatattgcaacatattactgtcagcagtacnhcnhcywccctcctwggacttttggcggagggaccaag

SEQ ID NO: 3141 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctccttwcacttttggcggagggaccaag

SEQ ID NO: 3142 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctcctmtcacttttggcggagggaccaag

SEQ ID NO: 3143 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnabhcnhcactcctcctwggacttttggcggagggaccaag

SEQ ID NO: 3144 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctccttwcacttttggcggagggaccaag

SEQ ID NO: 3145 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctcctmtcacttttggcggagggaccaag

SEQ ID NO: 3146 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
cctgaagattttgcaacttactactgtcagcaavnabhcagtbhccctcctwggacttttggcggagggaccaag

SEQ ID NO: 3147 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctccttwcacttttggcggagggaccaag

SEQ ID NO: 3148 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctcctmtcacttttggcggagggaccaag

SEQ ID NO: 3149 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (40)..(40): a, c, t or g
  misc_feature (40)..(40): n is a, c, g, or t
cctgaagattttgcaacttactactgtcagcaavnatacnhcbhccctcctwggacttttggcggagggaccaag

SEQ ID NO: 3150 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctccttwcacttttggcggagggaccaag

SEQ ID NO: 3151 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctcctmtcacttttggcggagggaccaag

SEQ ID NO: 3152 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcaacttactactgtcagcaaagcbhcnhcbhccctcctwggacttttggcggagggaccaag

SEQ ID NO: 3153 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctccttwcacttttggcggagggaccaag

SEQ ID NO: 3154 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctcctmtcacttttggcggagggaccaag

SEQ ID NO: 3155 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnasrmactcctcctwggacttttggcggagggaccaag

SEQ ID NO: 3156 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctccttwcacttttggcggagggaccaag

SEQ ID NO: 3157 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctcctmtcacttttggcggagggaccaag

SEQ ID NO: 3158 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
  modified_base (38)..(38): a, c, t or g
  misc_feature (38)..(38): n is a, c, g, or t
gctgaggatgttggggtttattactgcatgcagvnamnacagvbccctcctwggacttttggcggagggaccaag

SEQ ID NO: 3159 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctccttwcacttttggcggagggaccaag

SEQ ID NO: 3160 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctcctmtcacttttggcggagggaccaag

SEQ ID NO: 3161 - DNA, 75 bp, Artificial Sequence
  Description of Artificial Sequence: Synthetic oligonucleotide
  modified_base (35)..(35): a, c, t or g
  misc_feature (35)..(35): n is a, c, g, or t
gctgaggatgttggggtttattactgcatgcagvnactcsrmvbccctcctwggacttttggcggagggaccaag

SEQ ID NO: 3162 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctccttwcacttttggcggagggaccaag

SEQ ID NO: 3163 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctcctmtcacttttggcggagggaccaag

SEQ ID NO: 3164 - DNA, 75 bp, Artificial Sequence
  Description of Artificial Sequence: Synthetic oligonucleotide
  modified_base (38)..(38): a, c, t or g
  misc_feature (38)..(38): n is a, c, g, or t
gctgaggatgttggggtttattactgcatgcaggcamnasrmvbccctcctwggacttttggcggagggaccaag

SEQ ID NO: 3165 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctccttwcacttttggcggagggaccaag

SEQ ID NO: 3166 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctcctmtcacttttggcggagggaccaag

SEQ ID NO: 3167 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagbhcnhcnhctggcctcctwggacttttggcggagggaccaag

SEQ ID NO: 3168 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctccttwcacttttggcggagggaccaag

SEQ ID NO: 3169 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctcctmtcacttttggcggagggaccaag

SEQ ID NO: 3170 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
cctgaagattttgcagtttattactgtcagcagbhcnhcaatywccctcctwggacttttggcggagggaccaag

SEQ ID NO: 3171 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctccttwcacttttggcggagggaccaag

SEQ ID NO: 3172 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctcctmtcacttttggcggagggaccaag

SEQ ID NO: 3173 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
cctgaagattttgcagtttattactgtcagcagbhcagtnhcywccctcctwggacttttggcggagggaccaag

SEQ ID NO: 3174 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctccttwcacttttggcggagggaccaag

SEQ ID NO: 3175 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctcctmtcacttttggcggagggaccaag

SEQ ID NO: 3176 - DNA, 75 bp, Artificial Sequence
  Description of Artificial Sequence: Synthetic oligonucleotide
  modified_base (37)..(37): a, c, t or g
  misc_feature (37)..(37): n is a, c, g, or t
  modified_base (40)..(40): a, c, t or g
  misc_feature (40)..(40): n is a, c, g, or t
cctgaagattttgcagtttattactgtcagcagaganhcnhcywccctcctwggacttttggcggagggaccaag

SEQ ID NO: 3177 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctccttwcacttttggcggagggaccaag

SEQ ID NO: 3178 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctcctmtcacttttggcggagggaccaag

SEQ ID NO: 3179 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagbhcnhcnhctggcctcctwggacttttggcggagggaccaag

SEQ ID NO: 3180 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctccttwcacttttggcggagggaccaag

SEQ ID NO: 3181 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctcctmtcacttttggcggagggaccaag

SEQ ID NO: 3182 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
cagtctgaagattttgcagtttattactgtcagcagbhcnhcaatywccctcctwggacttttggcggagggaccaag

SEQ ID NO: 3183 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctccttwcacttttggcggagggaccaag

SEQ ID NO: 3184 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctcctmtcacttttggcggagggaccaag

SEQ ID NO: 3185 - DNA, 78 bp, Artificial Sequence
  Description of Artificial Sequence: Synthetic oligonucleotide
  modified_base (43)..(43): a, c, t or g
  misc_feature (43)..(43): n is a, c, g, or t
cagtctgaagattttgcagtttattactgtcagcagbhcaatnhcywccctcctwggacttttggcggagggaccaag

SEQ ID NO: 3186 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctccttwcacttttggcggagggaccaag

SEQ ID NO: 3187 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctcctmtcacttttggcggagggaccaag

SEQ ID NO: 3188 - DNA, 78 bp, Artificial Sequence
  Description of Artificial Sequence: Synthetic oligonucleotide
  modified_base (40)..(40): a, c, t or g
  misc_feature (40)..(40): n is a, c, g, or t
  modified_base (43)..(43): a, c, t or g
  misc_feature (43)..(43): n is a, c, g, or t
cagtctgaagattttgcagtttattactgtcagcagtacnhcnhcywccctcctwggacttttggcggagggaccaag

SEQ ID NO: 3189 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctccttwcacttttggcggagggaccaag

SEQ ID NO: 3190 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctcctmtcacttttggcggagggaccaag

SEQ ID NO: 3191 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcbhcvncagtcctcctwggacttttggcggagggaccaag

SEQ ID NO: 3192 - DNA, 75 bp, Artificial Sequence
  Description of Artificial Sequence: Synthetic oligonucleotide
cctgaagattttgcagtgtattactgtcagcagbhcbhcagtbhccctccttwcacttttggcggagggaccaag

SEQ ID NO: 3193 - DNA, 75 bp, Artificial Sequence
  Description of Artificial Sequence: Synthetic oligonucleotide
cctgaagattttgcagtgtattactgtcagcagbhcbhcagtbhccctcctmtcacttttggcggagggaccaag

SEQ ID NO: 3194 - DNA, 75 bp, Artificial Sequence
  Description of Artificial Sequence: Synthetic oligonucleotide
cctgaagattttgcagtgtattactgtcagcagbhcbhcagtbhccctcctwggacttttggcggagggaccaag

SEQ ID NO: 3195 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctccttwcacttttggcggagggaccaag

SEQ ID NO: 3196 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctcctmtcacttttggcggagggaccaag

SEQ ID NO: 3197 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagbhcggavncbhccctcctwggacttttggcggagggaccaag

SEQ ID NO: 3198 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctccttwcacttttggcggagggaccaag

SEQ ID NO: 3199 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctcctmtcacttttggcggagggaccaag

SEQ ID NO: 3200 - DNA, 75 bp, Artificial Sequence
  Description of Artificial Sequence: Synthetic oligonucleotide
  modified_base (41)..(41): a, c, t or g
  misc_feature (41)..(41): n is a, c, g, or t
cctgaagattttgcagtgtattactgtcagcagtacbhcvncbhccctcctwggacttttggcggagggaccaag

SEQ ID NO: 3201 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctccttwcacttttggcggagggaccaag

SEQ ID NO: 3202 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctcctmtcacttttggcggagggaccaag

SEQ ID NO: 3203 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhcbhcnhcactcctcctwggacttttggcggagggaccaag

SEQ ID NO: 3204 - DNA, 75 bp, Artificial Sequence
  Description of Artificial Sequence: Synthetic oligonucleotide
gctgaagatgtggcagtttattactgtcagcagbhcbhcagtbhccctccttwcacttttggcggagggaccaag

SEQ ID NO: 3205 - DNA, 75 bp, Artificial Sequence
  Description of Artificial Sequence: Synthetic oligonucleotide
gctgaagatgtggcagtttattactgtcagcagbhcbhcagtbhccctcctmtcacttttggcggagggaccaag

SEQ ID NO: 3206 - DNA, 75 bp, Artificial Sequence
  Description of Artificial Sequence: Synthetic oligonucleotide
gctgaagatgtggcagtttattactgtcagcagbhcbhcagtbhccctcctwggacttttggcggagggaccaag

SEQ ID NO: 3207 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctccttwcacttttggcggagggaccaag

SEQ ID NO: 3208 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctcctmtcacttttggcggagggaccaag

SEQ ID NO: 3209 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagbhctacnhcbhccctcctwggacttttggcggagggaccaag

SEQ ID NO: 3210 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctccttwcacttttggcggagggaccaag

SEQ ID NO: 3211 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctcctmtcacttttggcggagggaccaag

SEQ ID NO: 3212 - DNA, 75 bp, Artificial Sequence
  Description of Artificial Sequence: Synthetic oligonucleotide
  modified_base (40)..(40): a, c, t or g
  misc_feature (40)..(40): n is a, c, g, or t
gctgaagatgtggcagtttattactgtcagcagtacbhcnhcbhccctcctwggacttttggcggagggaccaag

SEQ ID NO: 3213 - DNA, 30 bp, Artificial Sequence
  Description of Artificial Sequence: Synthetic oligonucleotide
swmswmtacaatagttacyctccttwcact

SEQ ID NO: 3214 - DNA, 30 bp, Artificial Sequence
  Description of Artificial Sequence: Synthetic oligonucleotide
cagcagbhcvrmagttacyctccttwcact

SEQ ID NO: 3215 - DNA, 30 bp, Artificial Sequence
  Description of Artificial Sequence: Synthetic oligonucleotide
cagcagbhcaatmbctacyctccttwcact

SEQ ID NO: 3216 - DNA, 30 bp, Artificial Sequence
  Description of Artificial Sequence: Synthetic oligonucleotide
cagcagbhcaatagtywcyctccttwcact

SEQ ID NO: 3217 - DNA, 30 bp, Artificial Sequence
  Description of Artificial Sequence: Synthetic oligonucleotide
cagcagtacvrmmbctacyctccttwcact

SEQ ID NO: 3218 - DNA, 30 bp, Artificial Sequence
  Description of Artificial Sequence: Synthetic oligonucleotide
cagcagtacvrmagtywcyctccttwcact

SEQ ID NO: 3219 - DNA, 30 bp, Artificial Sequence
  Description of Artificial Sequence: Synthetic oligonucleotide
cagcagtacaatmbcywcyctccttwcact

SEQ ID NO: 3220 - DNA, 30 bp, Artificial Sequence
  Description of Artificial Sequence: Synthetic oligonucleotide
swmcagbhcaatagttacyctccttwcact

SEQ ID NO: 3221 - DNA, 30 bp, Artificial Sequence
  Description of Artificial Sequence: Synthetic oligonucleotide
swmcagtacvrmagttacyctccttwcact

SEQ ID NO: 3222 - DNA, 30 bp, Artificial Sequence
  Description of Artificial Sequence: Synthetic oligonucleotide
swmcagtacaatmbctacyctccttwcact

SEQ ID NO: 3223 - DNA, 30 bp, Artificial Sequence
  Description of Artificial Sequence: Synthetic oligonucleotide
swmcagtacaatagtywcyctccttwcact

SEQ ID NO: 3224 - DNA, 30 bp, Artificial Sequence
  Description of Artificial Sequence: Synthetic oligonucleotide
cagswmbhcaatagttacyctccttwcact

SEQ ID NO: 3225 - DNA, 30 bp, Artificial Sequence
  Description of Artificial Sequence: Synthetic oligonucleotide
cagswmtacvrmagttacyctccttwcact

SEQ ID NO: 3226 - DNA, 30 bp, Artificial Sequence
  Description of Artificial Sequence: Synthetic oligonucleotide
cagswmtacaatmbctacyctccttwcact

SEQ ID NO: 3227 - DNA, 30 bp, Artificial Sequence
  Description of Artificial Sequence: Synthetic oligonucleotide
cagswmtacaatagtywcyctccttwcact

SEQ ID NO: 3228 - DNA, 30 bp, Artificial Sequence
  Description of Artificial Sequence: Synthetic oligonucleotide
swmswmtacaatagttacyctcctmtcact

SEQ ID NO: 3229 - DNA, 30 bp, Artificial Sequence
  Description of Artificial Sequence: Synthetic oligonucleotide
cagcagbhcvrmagttacyctcctmtcact

SEQ ID NO: 3230 - DNA, 30 bp, Artificial Sequence
  Description of Artificial Sequence: Synthetic oligonucleotide
cagcagbhcaatmbctacyctcctmtcact

SEQ ID NO: 3231 - DNA, 30 bp, Artificial Sequence
  Description of Artificial Sequence: Synthetic oligonucleotide
cagcagbhcaatagtywcyctcctmtcact

SEQ ID NO: 3232 - DNA, 30 bp, Artificial Sequence
  Description of Artificial Sequence: Synthetic oligonucleotide
cagcagtacvrmmbctacyctcctmtcact

SEQ ID NO: 3233 - DNA, 30 bp, Artificial Sequence
  Description of Artificial Sequence: Synthetic oligonucleotide
cagcagtacvrmagtywcyctcctmtcact

SEQ ID NO: 3234 - DNA, 30 bp, Artificial Sequence
  Description of Artificial Sequence: Synthetic oligonucleotide
cagcagtacaatmbcywcyctcctmtcact

SEQ ID NO: 3235 - DNA, 30 bp, Artificial Sequence
  Description of Artificial Sequence: Synthetic oligonucleotide
swmcagbhcaatagttacyctcctmtcact

SEQ ID NO: 3236 - DNA, 30 bp, Artificial Sequence
  Description of Artificial Sequence: Synthetic oligonucleotide
swmcagtacvrmagttacyctcctmtcact

SEQ ID NO: 3237 - DNA, 30 bp, Artificial Sequence
  Description of Artificial Sequence: Synthetic oligonucleotide
swmcagtacaatmbctacyctcctmtcact

SEQ ID NO: 3238 - DNA, 30 bp, Artificial Sequence
  Description of Artificial Sequence: Synthetic oligonucleotide
swmcagtacaatagtywcyctcctmtcact

SEQ ID NO: 3239 - DNA, 30 bp, Artificial Sequence
  Description of Artificial Sequence: Synthetic oligonucleotide
cagswmbhcaatagttacyctcctmtcact

SEQ ID NO: 3240 - DNA, 30 bp, Artificial Sequence
  Description of Artificial Sequence: Synthetic oligonucleotide
cagswmtacvrmagttacyctcctmtcact

SEQ ID NO: 3241 - DNA, 30 bp, Artificial Sequence
  Description of Artificial Sequence: Synthetic oligonucleotide
cagswmtacaatmbctacyctcctmtcact

SEQ ID NO: 3242 - DNA, 30 bp, Artificial Sequence
  Description of Artificial Sequence: Synthetic oligonucleotide
cagswmtacaatagtywcyctcctmtcact

SEQ ID NO: 3243 - DNA, 30 bp, Artificial Sequence
  Description of Artificial Sequence: Synthetic oligonucleotide
swmswmtacaatagttacyctcctwggact

SEQ ID NO: 3244 - DNA, 30 bp, Artificial Sequence
  Description of Artificial Sequence: Synthetic oligonucleotide
cagcagbhcvrmagttacyctcctwggact

SEQ ID NO: 3245 - DNA, 30 bp, Artificial Sequence
  Description of Artificial Sequence: Synthetic oligonucleotide
cagcagbhcaatmbctacyctcctwggact

SEQ ID NO: 3246 - DNA, 30 bp, Artificial Sequence
  Description of Artificial Sequence: Synthetic oligonucleotide
cagcagbhcaatagtywcyctcctwggact

SEQ ID NO: 3247 - DNA, 30 bp, Artificial Sequence
  Description of Artificial Sequence: Synthetic oligonucleotide
cagcagtacvrmmbctacyctcctwggact

SEQ ID NO: 3248 - DNA, 30 bp, Artificial Sequence
  Description of Artificial Sequence: Synthetic oligonucleotide
cagcagtacvrmagtywcyctcctwggact

SEQ ID NO: 3249 - DNA, 30 bp, Artificial Sequence
  Description of Artificial Sequence: Synthetic oligonucleotide
cagcagtacaatmbcywcyctcctwggact

SEQ ID NO: 3250 - DNA, 30 bp, Artificial Sequence
  Description of Artificial Sequence: Synthetic oligonucleotide
swmcagbhcaatagttacyctcctwggact

SEQ ID NO: 3251 - DNA, 30 bp, Artificial Sequence
  Description of Artificial Sequence: Synthetic oligonucleotide
swmcagtacvrmagttacyctcctwggact

SEQ ID NO: 3252 - DNA, 30 bp, Artificial Sequence
  Description of Artificial Sequence: Synthetic oligonucleotide
swmcagtacaatmbctacyctcctwggact

SEQ ID NO: 3253 - DNA, 30 bp, Artificial Sequence
  Description of Artificial Sequence: Synthetic oligonucleotide
swmcagtacaatagtywcyctcctwggact

SEQ ID NO: 3254 - DNA, 30 bp, Artificial Sequence
  Description of Artificial Sequence: Synthetic oligonucleotide
cagswmbhcaatagttacyctcctwggact

SEQ ID NO: 3255 - DNA, 30 bp, Artificial Sequence
  Description of Artificial Sequence: Synthetic oligonucleotide
cagswmtacvrmagttacyctcctwggact

SEQ ID NO: 3256 - DNA, 30 bp, Artificial Sequence
  Description of Artificial Sequence: Synthetic oligonucleotide
cagswmtacaatmbctacyctcctwggact

SEQ ID NO: 3257 - DNA, 30 bp, Artificial Sequence
  Description of Artificial Sequence: Synthetic oligonucleotide
cagswmtacaatagtywcyctcctwggact

SEQ ID NO: 3258 - DNA, 30 bp, Artificial Sequence
  Description of Artificial Sequence: Synthetic oligonucleotide
swmswmgcaaatagtttccctccttwcact

SEQ ID NO: 3259 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctccttwcact

SEQ ID NO: 3260 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctccttwcact

SEQ ID NO: 3261 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctccttwcact

SEQ ID NO: 3262 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctccttwcact

SEQ ID NO: 3263 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctccttwcact

SEQ ID NO: 3264 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctccttwcact

SEQ ID NO: 3265 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctccttwcact

SEQ ID NO: 3266 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctccttwcact

SEQ ID NO: 3267 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctccttwcact

SEQ ID NO: 3268 - DNA, 30 bp, Artificial Sequence
  Description of Artificial Sequence: Synthetic oligonucleotide
swmcaggcaaatagtywccctccttwcact

SEQ ID NO: 3269 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctccttwcact

SEQ ID NO: 3270 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctccttwcact

SEQ ID NO: 3271 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctccttwcact

SEQ ID NO: 3272 - DNA, 30 bp, Artificial Sequence
  Description of Artificial Sequence: Synthetic oligonucleotide
cagswmgcaaatagtywccctccttwcact

SEQ ID NO: 3273 - DNA, 30 bp, Artificial Sequence
  Description of Artificial Sequence: Synthetic oligonucleotide
swmswmgcaaatagtttccctcctmtcact

SEQ ID NO: 3274 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctcctmtcact

SEQ ID NO: 3275 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctcctmtcact

SEQ ID NO: 3276 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctcctmtcact

SEQ ID NO: 3277 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctcctmtcact

SEQ ID NO: 3278 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctcctmtcact

SEQ ID NO: 3279 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctcctmtcact

SEQ ID NO: 3280 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctcctmtcact

SEQ ID NO: 3281 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctcctmtcact

SEQ ID NO: 3282 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctcctmtcact

SEQ ID NO: 3283 - DNA, 30 bp, Artificial Sequence
  Description of Artificial Sequence: Synthetic oligonucleotide
swmcaggcaaatagtywccctcctmtcact

SEQ ID NO: 3284 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctcctmtcact

SEQ ID NO: 3285 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctcctmtcact

SEQ ID NO: 3286 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctcctmtcact

SEQ ID NO: 3287 - DNA, 30 bp, Artificial Sequence
  Description of Artificial Sequence: Synthetic oligonucleotide
cagswmgcaaatagtywccctcctmtcact

SEQ ID NO: 3288 - DNA, 30 bp, Artificial Sequence
  Description of Artificial Sequence: Synthetic oligonucleotide
swmswmgcaaatagtttccctcctwggact

SEQ ID NO: 3289 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtttccctcctwggact

SEQ ID NO: 3290 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcttccctcctwggact

SEQ ID NO: 3291 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcagrnaaatagtywccctcctwggact

SEQ ID NO: 3292 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcttccctcctwggact

SEQ ID NO: 3293 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcaggcanhcagtywccctcctwggact

SEQ ID NO: 3294 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaggcaaatnhcywccctcctwggact

SEQ ID NO: 3295 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcagrnaaatagtttccctcctwggact

SEQ ID NO: 3296 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcaggcanhcagtttccctcctwggact

SEQ ID NO: 3297 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaggcaaatnhcttccctcctwggact

SEQ ID NO: 3298 - DNA, 30 bp, Artificial Sequence
  Description of Artificial Sequence: Synthetic oligonucleotide
swmcaggcaaatagtywccctcctwggact

SEQ ID NO: 3299 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmrnaaatagtttccctcctwggact

SEQ ID NO: 3300 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmgcanhcagtttccctcctwggact

SEQ ID NO: 3301 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmgcaaatnhcttccctcctwggact

SEQ ID NO: 3302 - DNA, 30 bp, Artificial Sequence
  Description of Artificial Sequence: Synthetic oligonucleotide
cagswmgcaaatagtywccctcctwggact

SEQ ID NO: 3303 - DNA, 30 bp, Artificial Sequence
  Description of Artificial Sequence: Synthetic oligonucleotide
swmswmtacgataatctccctccttwcact

SEQ ID NO: 3304 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctccttwcact

SEQ ID NO: 3305 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctccttwcact

SEQ ID NO: 3306 - DNA, 30 bp, Artificial Sequence
  Description of Artificial Sequence: Synthetic oligonucleotide
cagcagbhcgataatywccctccttwcact

SEQ ID NO: 3307 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctccttwcact

SEQ ID NO: 3308 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctccttwcact

SEQ ID NO: 3309 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctccttwcact

SEQ ID NO: 3310 - DNA, 30 bp, Artificial Sequence
  Description of Artificial Sequence: Synthetic oligonucleotide
swmcagbhcgataatctccctccttwcact

SEQ ID NO: 3311 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctccttwcact

SEQ ID NO: 3312 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctccttwcact

SEQ ID NO: 3313 - DNA, 30 bp, Artificial Sequence
  Description of Artificial Sequence: Synthetic oligonucleotide
swmcagtacgataatywccctccttwcact

SEQ ID NO: 3314 - DNA, 30 bp, Artificial Sequence
  Description of Artificial Sequence: Synthetic oligonucleotide
cagswmbhcgataatctccctccttwcact

SEQ ID NO: 3315 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctccttwcact

SEQ ID NO: 3316 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctccttwcact

SEQ ID NO: 3317 - DNA, 30 bp, Artificial Sequence
  Description of Artificial Sequence: Synthetic oligonucleotide
cagswmtacgataatywccctccttwcact

SEQ ID NO: 3318 - DNA, 30 bp, Artificial Sequence
  Description of Artificial Sequence: Synthetic oligonucleotide
swmswmtacgataatctccctcctmtcact

SEQ ID NO: 3319 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctcctmtcact

SEQ ID NO: 3320 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctcctmtcact

SEQ ID NO: 3321 - DNA, 30 bp, Artificial Sequence
  Description of Artificial Sequence: Synthetic oligonucleotide
cagcagbhcgataatywccctcctmtcact

SEQ ID NO: 3322 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctcctmtcact

SEQ ID NO: 3323 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctcctmtcact

SEQ ID NO: 3324 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctcctmtcact

SEQ ID NO: 3325 - DNA, 30 bp, Artificial Sequence
  Description of Artificial Sequence: Synthetic oligonucleotide
swmcagbhcgataatctccctcctmtcact

SEQ ID NO: 3326 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctcctmtcact

SEQ ID NO: 3327 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctcctmtcact

SEQ ID NO: 3328 - DNA, 30 bp, Artificial Sequence
  Description of Artificial Sequence: Synthetic oligonucleotide
swmcagtacgataatywccctcctmtcact

SEQ ID NO: 3329 - DNA, 30 bp, Artificial Sequence
  Description of Artificial Sequence: Synthetic oligonucleotide
cagswmbhcgataatctccctcctmtcact

SEQ ID NO: 3330 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctcctmtcact

SEQ ID NO: 3331 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctcctmtcact

SEQ ID NO: 3332 - DNA, 30 bp, Artificial Sequence
  Description of Artificial Sequence: Synthetic oligonucleotide
cagswmtacgataatywccctcctmtcact

SEQ ID NO: 3333 - DNA, 30 bp, Artificial Sequence
  Description of Artificial Sequence: Synthetic oligonucleotide
swmswmtacgataatctccctcctwggact

SEQ ID NO: 3334 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatctccctcctwggact

SEQ ID NO: 3335 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcctccctcctwggact

SEQ ID NO: 3336 - DNA, 30 bp, Artificial Sequence
  Description of Artificial Sequence: Synthetic oligonucleotide
cagcagbhcgataatywccctcctwggact

SEQ ID NO: 3337 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcctccctcctwggact

SEQ ID NO: 3338 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagtacnhcaatywccctcctwggact

SEQ ID NO: 3339 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacgatnhcywccctcctwggact

SEQ ID NO: 3340 - DNA, 30 bp, Artificial Sequence
  Description of Artificial Sequence: Synthetic oligonucleotide
swmcagbhcgataatctccctcctwggact

SEQ ID NO: 3341 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaatctccctcctwggact

SEQ ID NO: 3342 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacgatnhcctccctcctwggact

SEQ ID NO: 3343 - DNA, 30 bp, Artificial Sequence
  Description of Artificial Sequence: Synthetic oligonucleotide
swmcagtacgataatywccctcctwggact

SEQ ID NO: 3344 - DNA, 30 bp, Artificial Sequence
  Description of Artificial Sequence: Synthetic oligonucleotide
cagswmbhcgataatctccctcctwggact

SEQ ID NO: 3345 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaatctccctcctwggact

SEQ ID NO: 3346 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacgatnhcctccctcctwggact

SEQ ID NO: 3347 - DNA, 30 bp, Artificial Sequence
  Description of Artificial Sequence: Synthetic oligonucleotide
cagswmtacgataatywccctcctwggact

SEQ ID NO: 3348 - DNA, 30 bp, Artificial Sequence
  Description of Artificial Sequence: Synthetic oligonucleotide
swmswmagctacagtactcctccttwcact

SEQ ID NO: 3349 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctccttwcact

SEQ ID NO: 3350 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctccttwcact

SEQ ID NO: 3351 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctccttwcact

SEQ ID NO: 3352 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctccttwcact

SEQ ID NO: 3353 - DNA, 30 bp, Artificial Sequence
  Description of Artificial Sequence: Synthetic oligonucleotide
cagcaaagcbhcagtbhccctccttwcact

SEQ ID NO: 3354 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctccttwcact

SEQ ID NO: 3355 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctccttwcact

SEQ ID NO: 3356 - DNA, 30 bp, Artificial Sequence
  Description of Artificial Sequence: Synthetic oligonucleotide
swmcaaagcbhcagtactcctccttwcact

SEQ ID NO: 3357 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctccttwcact

SEQ ID NO: 3358 - DNA, 30 bp, Artificial Sequence
  Description of Artificial Sequence: Synthetic oligonucleotide
swmcaaagctacagtbhccctccttwcact

SEQ ID NO: 3359 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctccttwcact

SEQ ID NO: 3360 - DNA, 30 bp, Artificial Sequence
  Description of Artificial Sequence: Synthetic oligonucleotide
cagswmagcbhcagtactcctccttwcact

SEQ ID NO: 3361 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctccttwcact

SEQ ID NO: 3362 - DNA, 30 bp, Artificial Sequence
  Description of Artificial Sequence: Synthetic oligonucleotide
cagswmagctacagtbhccctccttwcact

SEQ ID NO: 3363 - DNA, 30 bp, Artificial Sequence
  Description of Artificial Sequence: Synthetic oligonucleotide
swmswmagctacagtactcctcctmtcact

SEQ ID NO: 3364 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctcctmtcact

SEQ ID NO: 3365 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctcctmtcact

SEQ ID NO: 3366 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctcctmtcact

SEQ ID NO: 3367 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctcctmtcact

SEQ ID NO: 3368 - DNA, 30 bp, Artificial Sequence
  Description of Artificial Sequence: Synthetic oligonucleotide
cagcaaagcbhcagtbhccctcctmtcact

SEQ ID NO: 3369 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctcctmtcact

SEQ ID NO: 3370 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctcctmtcact

SEQ ID NO: 3371 - DNA, 30 bp, Artificial Sequence
  Description of Artificial Sequence: Synthetic oligonucleotide
swmcaaagcbhcagtactcctcctmtcact

SEQ ID NO: 3372 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctcctmtcact

SEQ ID NO: 3373 - DNA, 30 bp, Artificial Sequence
  Description of Artificial Sequence: Synthetic oligonucleotide
swmcaaagctacagtbhccctcctmtcact

SEQ ID NO: 3374 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctcctmtcact

SEQ ID NO: 3375 - DNA, 30 bp, Artificial Sequence
  Description of Artificial Sequence: Synthetic oligonucleotide
cagswmagcbhcagtactcctcctmtcact

SEQ ID NO: 3376 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctcctmtcact

SEQ ID NO: 3377 - DNA, 30 bp, Artificial Sequence
  Description of Artificial Sequence: Synthetic oligonucleotide
cagswmagctacagtbhccctcctmtcact

SEQ ID NO: 3378 - DNA, 30 bp, Artificial Sequence
  Description of Artificial Sequence: Synthetic oligonucleotide
swmswmagctacagtactcctcctwggact

SEQ ID NO: 3379 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtactcctcctwggact

SEQ ID NO: 3380 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcactcctcctwggact

SEQ ID NO: 3381 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnatacagtbhccctcctwggact

SEQ ID NO: 3382 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcactcctcctwggact

SEQ ID NO: 3383 - DNA, 30 bp, Artificial Sequence
  Description of Artificial Sequence: Synthetic oligonucleotide
cagcaaagcbhcagtbhccctcctwggact

SEQ ID NO: 3384 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagctacnhcbhccctcctwggact

SEQ ID NO: 3385 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
swmcaavnatacagtactcctcctwggact

SEQ ID NO: 3386 - DNA, 30 bp, Artificial Sequence
  Description of Artificial Sequence: Synthetic oligonucleotide
swmcaaagcbhcagtactcctcctwggact

SEQ ID NO: 3387 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcaaagctacnhcactcctcctwggact

SEQ ID NO: 3388 - DNA, 30 bp, Artificial Sequence
  Description of Artificial Sequence: Synthetic oligonucleotide
swmcaaagctacagtbhccctcctwggact

SEQ ID NO: 3389 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagswmvnatacagtactcctcctwggact

SEQ ID NO: 3390 - DNA, 30 bp, Artificial Sequence
  Description of Artificial Sequence: Synthetic oligonucleotide
cagswmagcbhcagtactcctcctwggact

SEQ ID NO: 3391 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagctacnhcactcctcctwggact

SEQ ID NO: 3392 - DNA, 30 bp, Artificial Sequence
  Description of Artificial Sequence: Synthetic oligonucleotide
cagswmagctacagtbhccctcctwggact

SEQ ID NO: 3393 - DNA, 30 bp, Artificial Sequence
  Description of Artificial Sequence: Synthetic oligonucleotide
dtsswmgcactccagactcctccttwcact

SEQ ID NO: 3394 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctccttwcact

SEQ ID NO: 3395 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctccttwcact

SEQ ID NO: 3396 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctccttwcact

SEQ ID NO: 3397 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctccttwcact

SEQ ID NO: 3398 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctccttwcact

SEQ ID NO: 3399 - DNA, 30 bp, Artificial Sequence
  Description of Artificial Sequence: Synthetic oligonucleotide
atgcaggcactcsrmvbccctccttwcact

SEQ ID NO: 3400 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctccttwcact

SEQ ID NO: 3401 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctccttwcact

SEQ ID NO: 3402 - DNA, 30 bp, Artificial Sequence
  Description of Artificial Sequence: Synthetic oligonucleotide
dtscaggcactcsrmactcctccttwcact

SEQ ID NO: 3403 - DNA, 30 bp, Artificial Sequence
  Description of Artificial Sequence: Synthetic oligonucleotide
dtscaggcactccagvbccctccttwcact

SEQ ID NO: 3404 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctccttwcact

SEQ ID NO: 3405 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctccttwcact

SEQ ID NO: 3406 - DNA, 30 bp, Artificial Sequence
  Description of Artificial Sequence: Synthetic oligonucleotide
atgswmgcactcsrmactcctccttwcact

SEQ ID NO: 3407 - DNA, 30 bp, Artificial Sequence
  Description of Artificial Sequence: Synthetic oligonucleotide
atgswmgcactccagvbccctccttwcact

SEQ ID NO: 3408 - DNA, 30 bp, Artificial Sequence
  Description of Artificial Sequence: Synthetic oligonucleotide
dtsswmgcactccagactcctcctmtcact

SEQ ID NO: 3409 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctcctmtcact

SEQ ID NO: 3410 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctcctmtcact

SEQ ID NO: 3411 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctcctmtcact

SEQ ID NO: 3412 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctcctmtcact

SEQ ID NO: 3413 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctcctmtcact

SEQ ID NO: 3414 - DNA, 30 bp, Artificial Sequence
  Description of Artificial Sequence: Synthetic oligonucleotide
atgcaggcactcsrmvbccctcctmtcact

SEQ ID NO: 3415 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctcctmtcact

SEQ ID NO: 3416 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctcctmtcact

SEQ ID NO: 3417 - DNA, 30 bp, Artificial Sequence
  Description of Artificial Sequence: Synthetic oligonucleotide
dtscaggcactcsrmactcctcctmtcact

SEQ ID NO: 3418 - DNA, 30 bp, Artificial Sequence
  Description of Artificial Sequence: Synthetic oligonucleotide
dtscaggcactccagvbccctcctmtcact

SEQ ID NO: 3419 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctcctmtcact

SEQ ID NO: 3420 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctcctmtcact

SEQ ID NO: 3421 - DNA, 30 bp, Artificial Sequence
  Description of Artificial Sequence: Synthetic oligonucleotide
atgswmgcactcsrmactcctcctmtcact

SEQ ID NO: 3422 - DNA, 30 bp, Artificial Sequence
  Description of Artificial Sequence: Synthetic oligonucleotide
atgswmgcactccagvbccctcctmtcact

SEQ ID NO: 3423 - DNA, 30 bp, Artificial Sequence
  Description of Artificial Sequence: Synthetic oligonucleotide
dtsswmgcactccagactcctcctwggact

SEQ ID NO: 3424 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagactcctcctwggact

SEQ ID NO: 3425 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmactcctcctwggact

SEQ ID NO: 3426 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactccagvbccctcctwggact

SEQ ID NO: 3427 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmactcctcctwggact

SEQ ID NO: 3428 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnacagvbccctcctwggact

SEQ ID NO: 3429 - DNA, 30 bp, Artificial Sequence
  Description of Artificial Sequence: Synthetic oligonucleotide
atgcaggcactcsrmvbccctcctwggact

SEQ ID NO: 3430 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
dtscagvnactccagactcctcctwggact

SEQ ID NO: 3431 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
dtscaggcamnacagactcctcctwggact

SEQ ID NO: 3432 - DNA, 30 bp, Artificial Sequence
  Description of Artificial Sequence: Synthetic oligonucleotide
dtscaggcactcsrmactcctcctwggact

SEQ ID NO: 3433 - DNA, 30 bp, Artificial Sequence
  Description of Artificial Sequence: Synthetic oligonucleotide
dtscaggcactccagvbccctcctwggact

SEQ ID NO: 3434 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgswmvnactccagactcctcctwggact

SEQ ID NO: 3435 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgswmgcamnacagactcctcctwggact

SEQ ID NO: 3436 - DNA, 30 bp, Artificial Sequence
  Description of Artificial Sequence: Synthetic oligonucleotide
atgswmgcactcsrmactcctcctwggact

SEQ ID NO: 3437 - DNA, 30 bp, Artificial Sequence
  Description of Artificial Sequence: Synthetic oligonucleotide
atgswmgcactccagvbccctcctwggact

SEQ ID NO: 3438 - DNA, 30 bp, Artificial Sequence
  Description of Artificial Sequence: Synthetic oligonucleotide
swmswmagaagtaattggcctccttwcact

SEQ ID NO: 3439 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctccttwcact

SEQ ID NO: 3440 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctccttwcact

SEQ ID NO: 3441 - DNA, 30 bp, Artificial Sequence
  Description of Artificial Sequence: Synthetic oligonucleotide
cagcagbhcagtaatywccctccttwcact

SEQ ID NO: 3442 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctccttwcact

SEQ ID NO: 3443 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctccttwcact

SEQ ID NO: 3444 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctccttwcact

SEQ ID NO: 3445 - DNA, 30 bp, Artificial Sequence
  Description of Artificial Sequence: Synthetic oligonucleotide
swmcagbhcagtaattggcctccttwcact

SEQ ID NO: 3446 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctccttwcact

SEQ ID NO: 3447 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctccttwcact

SEQ ID NO: 3448 - DNA, 30 bp, Artificial Sequence
  Description of Artificial Sequence: Synthetic oligonucleotide
swmcagagaagtaatywccctccttwcact

SEQ ID NO: 3449 - DNA, 30 bp, Artificial Sequence
  Description of Artificial Sequence: Synthetic oligonucleotide
cagswmbhcagtaattggcctccttwcact

SEQ ID NO: 3450 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctccttwcact

SEQ ID NO: 3451 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctccttwcact

SEQ ID NO: 3452 - DNA, 30 bp, Artificial Sequence
  Description of Artificial Sequence: Synthetic oligonucleotide
cagswmagaagtaatywccctccttwcact

SEQ ID NO: 3453 - DNA, 30 bp, Artificial Sequence
  Description of Artificial Sequence: Synthetic oligonucleotide
swmswmagaagtaattggcctcctmtcact

SEQ ID NO: 3454 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctcctmtcact

SEQ ID NO: 3455 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctcctmtcact

SEQ ID NO: 3456 - DNA, 30 bp, Artificial Sequence
  Description of Artificial Sequence: Synthetic oligonucleotide
cagcagbhcagtaatywccctcctmtcact

SEQ ID NO: 3457 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctcctmtcact

SEQ ID NO: 3458 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctcctmtcact

SEQ ID NO: 3459 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctcctmtcact

SEQ ID NO: 3460 - DNA, 30 bp, Artificial Sequence
  Description of Artificial Sequence: Synthetic oligonucleotide
swmcagbhcagtaattggcctcctmtcact

SEQ ID NO: 3461 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctcctmtcact

SEQ ID NO: 3462 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctcctmtcact

SEQ ID NO: 3463 - DNA, 30 bp, Artificial Sequence
  Description of Artificial Sequence: Synthetic oligonucleotide
swmcagagaagtaatywccctcctmtcact

SEQ ID NO: 3464 - DNA, 30 bp, Artificial Sequence
  Description of Artificial Sequence: Synthetic oligonucleotide
cagswmbhcagtaattggcctcctmtcact

SEQ ID NO: 3465 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctcctmtcact

SEQ ID NO: 3466 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctcctmtcact

SEQ ID NO: 3467 - DNA, 30 bp, Artificial Sequence
  Description of Artificial Sequence: Synthetic oligonucleotide
cagswmagaagtaatywccctcctmtcact

SEQ ID NO: 3468 - DNA, 30 bp, Artificial Sequence
  Description of Artificial Sequence: Synthetic oligonucleotide
swmswmagaagtaattggcctcctwggact

SEQ ID NO: 3469 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaattggcctcctwggact

SEQ ID NO: 3470 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhctggcctcctwggact

SEQ ID NO: 3471 - DNA, 30 bp, Artificial Sequence
  Description of Artificial Sequence: Synthetic oligonucleotide
cagcagbhcagtaatywccctcctwggact

SEQ ID NO: 3472 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhctggcctcctwggact

SEQ ID NO: 3473 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagaganhcaatywccctcctwggact

SEQ ID NO: 3474 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagagaagtnhcywccctcctwggact

SEQ ID NO: 3475 - DNA, 30 bp, Artificial Sequence
  Description of Artificial Sequence: Synthetic oligonucleotide
swmcagbhcagtaattggcctcctwggact

SEQ ID NO: 3476 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagaganhcaattggcctcctwggact

SEQ ID NO: 3477 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagagaagtnhctggcctcctwggact

SEQ ID NO: 3478 - DNA, 30 bp, Artificial Sequence
  Description of Artificial Sequence: Synthetic oligonucleotide
swmcagagaagtaatywccctcctwggact

SEQ ID NO: 3479 - DNA, 30 bp, Artificial Sequence
  Description of Artificial Sequence: Synthetic oligonucleotide
cagswmbhcagtaattggcctcctwggact

SEQ ID NO: 3480 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmaganhcaattggcctcctwggact

SEQ ID NO: 3481 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmagaagtnhctggcctcctwggact

SEQ ID NO: 3482 - DNA, 30 bp, Artificial Sequence
  Description of Artificial Sequence: Synthetic oligonucleotide
cagswmagaagtaatywccctcctwggact

SEQ ID NO: 3483 - DNA, 30 bp, Artificial Sequence
  Description of Artificial Sequence: Synthetic oligonucleotide
swmswmtacaataattggcctccttwcact

SEQ ID NO: 3484 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctccttwcact

SEQ ID NO: 3485 - DNA, 30 bp, Artificial Sequence
  Description of Artificial Sequence: Synthetic oligonucleotide
cagcagbhcaataatywccctccttwcact

SEQ ID NO: 3486 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctccttwcact

SEQ ID NO: 3487 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctccttwcact

SEQ ID NO: 3488 - DNA, 30 bp, Artificial Sequence
  Description of Artificial Sequence: Synthetic oligonucleotide
swmcagbhcaataattggcctccttwcact

SEQ ID NO: 3489 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctccttwcact

SEQ ID NO: 3490 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctccttwcact

SEQ ID NO: 3491 - DNA, 30 bp, Artificial Sequence
  Description of Artificial Sequence: Synthetic oligonucleotide
swmcagtacaataatywccctccttwcact

SEQ ID NO: 3492 - DNA, 30 bp, Artificial Sequence
  Description of Artificial Sequence: Synthetic oligonucleotide
cagswmbhcaataattggcctccttwcact

SEQ ID NO: 3493 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctccttwcact

SEQ ID NO: 3494 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctccttwcact

SEQ ID NO: 3495 - DNA, 30 bp, Artificial Sequence
  Description of Artificial Sequence: Synthetic oligonucleotide
cagswmtacaataatywccctccttwcact

SEQ ID NO: 3496 - DNA, 30 bp, Artificial Sequence
  Description of Artificial Sequence: Synthetic oligonucleotide
swmswmtacaataattggcctcctmtcact

SEQ ID NO: 3497 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctcctmtcact

SEQ ID NO: 3498 - DNA, 30 bp, Artificial Sequence
  Description of Artificial Sequence: Synthetic oligonucleotide
cagcagbhcaataatywccctcctmtcact

SEQ ID NO: 3499 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctcctmtcact

SEQ ID NO: 3500 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctcctmtcact

SEQ ID NO: 3501 - DNA, 30 bp, Artificial Sequence
  Description of Artificial Sequence: Synthetic oligonucleotide
swmcagbhcaataattggcctcctmtcact

SEQ ID NO: 3502 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctcctmtcact

SEQ ID NO: 3503 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctcctmtcact

SEQ ID NO: 3504 - DNA, 30 bp, Artificial Sequence
  Description of Artificial Sequence: Synthetic oligonucleotide
swmcagtacaataatywccctcctmtcact

SEQ ID NO: 3505 - DNA, 30 bp, Artificial Sequence
  Description of Artificial Sequence: Synthetic oligonucleotide
cagswmbhcaataattggcctcctmtcact

SEQ ID NO: 3506 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctcctmtcact

SEQ ID NO: 3507 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctcctmtcact

SEQ ID NO: 3508 - DNA, 30 bp, Artificial Sequence
  Description of Artificial Sequence: Synthetic oligonucleotide
cagswmtacaataatywccctcctmtcact

SEQ ID NO: 3509 - DNA, 30 bp, Artificial Sequence
  Description of Artificial Sequence: Synthetic oligonucleotide
swmswmtacaataattggcctcctwggact

SEQ ID NO: 3510 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhctggcctcctwggact

SEQ ID NO: 3511 - DNA, 30 bp, Artificial Sequence
  Description of Artificial Sequence: Synthetic oligonucleotide
cagcagbhcaataatywccctcctwggact

SEQ ID NO: 3512 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhctggcctcctwggact

SEQ ID NO: 3513 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacaatnhcywccctcctwggact

SEQ ID NO: 3514 - DNA, 30 bp, Artificial Sequence
  Description of Artificial Sequence: Synthetic oligonucleotide
swmcagbhcaataattggcctcctwggact

SEQ ID NO: 3515 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
swmcagtacnhcaattggcctcctwggact

SEQ ID NO: 3516 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
swmcagtacaatnhctggcctcctwggact

SEQ ID NO: 3517 - DNA, 30 bp, Artificial Sequence
  Description of Artificial Sequence: Synthetic oligonucleotide
swmcagtacaataatywccctcctwggact

SEQ ID NO: 3518 - DNA, 30 bp, Artificial Sequence
  Description of Artificial Sequence: Synthetic oligonucleotide
cagswmbhcaataattggcctcctwggact

SEQ ID NO: 3519 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagswmtacnhcaattggcctcctwggact

SEQ ID NO: 3520 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagswmtacaatnhctggcctcctwggact

SEQ ID NO: 3521 - DNA, 30 bp, Artificial Sequence
  Description of Artificial Sequence: Synthetic oligonucleotide
cagswmtacaataatywccctcctwggact

SEQ ID NO: 3522 - DNA, 30 bp, Artificial Sequence
  Description of Artificial Sequence: Synthetic oligonucleotide
swmswmtacggaagtagtcctccttwcact

SEQ ID NO: 3523 - DNA, 30 bp, Artificial Sequence
  Description of Artificial Sequence: Synthetic oligonucleotide
cagcagbhcbhcagtagtcctccttwcact

SEQ ID NO: 3524 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctccttwcact

SEQ ID NO: 3525 - DNA, 30 bp, Artificial Sequence
  Description of Artificial Sequence: Synthetic oligonucleotide
cagcagbhcggaagtbhccctccttwcact

SEQ ID NO: 3526 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctccttwcact

SEQ ID NO: 3527 - DNA, 30 bp, Artificial Sequence
  Description of Artificial Sequence: Synthetic oligonucleotide
cagcagtacbhcagtbhccctccttwcact

SEQ ID NO: 3528 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctccttwcact

SEQ ID NO: 3529 - DNA, 30 bp, Artificial Sequence
  Description of Artificial Sequence: Synthetic oligonucleotide
swmcagbhcggaagtagtcctccttwcact

SEQ ID NO: 3530 - DNA, 30 bp, Artificial Sequence
  Description of Artificial Sequence: Synthetic oligonucleotide
swmcagtacbhcagtagtcctccttwcact

SEQ ID NO: 3531 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctccttwcact

SEQ ID NO: 3532 - DNA, 30 bp, Artificial Sequence
  Description of Artificial Sequence: Synthetic oligonucleotide
swmcagtacggaagtbhccctccttwcact

SEQ ID NO: 3533 - DNA, 30 bp, Artificial Sequence
  Description of Artificial Sequence: Synthetic oligonucleotide
cagswmbhcggaagtagtcctccttwcact

SEQ ID NO: 3534 - DNA, 30 bp, Artificial Sequence
  Description of Artificial Sequence: Synthetic oligonucleotide
cagswmtacbhcagtagtcctccttwcact

SEQ ID NO: 3535 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctccttwcact

SEQ ID NO: 3536 - DNA, 30 bp, Artificial Sequence
  Description of Artificial Sequence: Synthetic oligonucleotide
cagswmtacggaagtbhccctccttwcact

SEQ ID NO: 3537 - DNA, 30 bp, Artificial Sequence
  Description of Artificial Sequence: Synthetic oligonucleotide
swmswmtacggaagtagtcctcctmtcact

SEQ ID NO: 3538 - DNA, 30 bp, Artificial Sequence
  Description of Artificial Sequence: Synthetic oligonucleotide
cagcagbhcbhcagtagtcctcctmtcact

SEQ ID NO: 3539 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctcctmtcact

SEQ ID NO: 3540 - DNA, 30 bp, Artificial Sequence
  Description of Artificial Sequence: Synthetic oligonucleotide
cagcagbhcggaagtbhccctcctmtcact

SEQ ID NO: 3541 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctcctmtcact

SEQ ID NO: 3542 - DNA, 30 bp, Artificial Sequence
  Description of Artificial Sequence: Synthetic oligonucleotide
cagcagtacbhcagtbhccctcctmtcact

SEQ ID NO: 3543 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctcctmtcact

SEQ ID NO: 3544 - DNA, 30 bp, Artificial Sequence
  Description of Artificial Sequence: Synthetic oligonucleotide
swmcagbhcggaagtagtcctcctmtcact

SEQ ID NO: 3545 - DNA, 30 bp, Artificial Sequence
  Description of Artificial Sequence: Synthetic oligonucleotide
swmcagtacbhcagtagtcctcctmtcact

SEQ ID NO: 3546 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctcctmtcact

SEQ ID NO: 3547 - DNA, 30 bp, Artificial Sequence
  Description of Artificial Sequence: Synthetic oligonucleotide
swmcagtacggaagtbhccctcctmtcact

SEQ ID NO: 3548 - DNA, 30 bp, Artificial Sequence
  Description of Artificial Sequence: Synthetic oligonucleotide
cagswmbhcggaagtagtcctcctmtcact

SEQ ID NO: 3549 - DNA, 30 bp, Artificial Sequence
  Description of Artificial Sequence: Synthetic oligonucleotide
cagswmtacbhcagtagtcctcctmtcact

SEQ ID NO: 3550 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctcctmtcact

SEQ ID NO: 3551 - DNA, 30 bp, Artificial Sequence
  Description of Artificial Sequence: Synthetic oligonucleotide
cagswmtacggaagtbhccctcctmtcact

SEQ ID NO: 3552 - DNA, 30 bp, Artificial Sequence
  Description of Artificial Sequence: Synthetic oligonucleotide
swmswmtacggaagtagtcctcctwggact

SEQ ID NO: 3553 - DNA, 30 bp, Artificial Sequence
  Description of Artificial Sequence: Synthetic oligonucleotide
cagcagbhcbhcagtagtcctcctwggact

SEQ ID NO: 3554 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncagtcctcctwggact

SEQ ID NO: 3555 - DNA, 30 bp, Artificial Sequence
  Description of Artificial Sequence: Synthetic oligonucleotide
cagcagbhcggaagtbhccctcctwggact

SEQ ID NO: 3556 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncagtcctcctwggact

SEQ ID NO: 3557 - DNA, 30 bp, Artificial Sequence
  Description of Artificial Sequence: Synthetic oligonucleotide
cagcagtacbhcagtbhccctcctwggact

SEQ ID NO: 3558 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacggavncbhccctcctwggact

SEQ ID NO: 3559 - DNA, 30 bp, Artificial Sequence
  Description of Artificial Sequence: Synthetic oligonucleotide
swmcagbhcggaagtagtcctcctwggact

SEQ ID NO: 3560 - DNA, 30 bp, Artificial Sequence
  Description of Artificial Sequence: Synthetic oligonucleotide
swmcagtacbhcagtagtcctcctwggact

SEQ ID NO: 3561 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
swmcagtacggavncagtcctcctwggact

SEQ ID NO: 3562 - DNA, 30 bp, Artificial Sequence
  Description of Artificial Sequence: Synthetic oligonucleotide
swmcagtacggaagtbhccctcctwggact

SEQ ID NO: 3563 - DNA, 30 bp, Artificial Sequence
  Description of Artificial Sequence: Synthetic oligonucleotide
cagswmbhcggaagtagtcctcctwggact

SEQ ID NO: 3564 - DNA, 30 bp, Artificial Sequence
  Description of Artificial Sequence: Synthetic oligonucleotide
cagswmtacbhcagtagtcctcctwggact

SEQ ID NO: 3565 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagswmtacggavncagtcctcctwggact

SEQ ID NO: 3566 - DNA, 30 bp, Artificial Sequence
  Description of Artificial Sequence: Synthetic oligonucleotide
cagswmtacggaagtbhccctcctwggact

SEQ ID NO: 3567 - DNA, 30 bp, Artificial Sequence
  Description of Artificial Sequence: Synthetic oligonucleotide
cagcagbhcvrmmbctacyctccttwcact

SEQ ID NO: 3568 - DNA, 30 bp, Artificial Sequence
  Description of Artificial Sequence: Synthetic oligonucleotide
cagcagbhcvrmmbctacyctcctmtcact

SEQ ID NO: 3569 - DNA, 30 bp, Artificial Sequence
  Description of Artificial Sequence: Synthetic oligonucleotide
cagcagbhcvrmmbctacyctcctwggact

SEQ ID NO: 3570 - DNA, 30 bp, Artificial Sequence
  Description of Artificial Sequence: Synthetic oligonucleotide
cagcagbhcaatmbcywcyctccttwcact

SEQ ID NO: 3571 - DNA, 30 bp, Artificial Sequence
  Description of Artificial Sequence: Synthetic oligonucleotide
cagcagbhcaatmbcywcyctcctmtcact

SEQ ID NO: 3572 - DNA, 30 bp, Artificial Sequence
  Description of Artificial Sequence: Synthetic oligonucleotide
cagcagbhcaatmbcywcyctcctwggact

SEQ ID NO: 3573 - DNA, 30 bp, Artificial Sequence
  Description of Artificial Sequence: Synthetic oligonucleotide
cagcagbhcvrmagtywcyctccttwcact

SEQ ID NO: 3574 - DNA, 30 bp, Artificial Sequence
  Description of Artificial Sequence: Synthetic oligonucleotide
cagcagbhcvrmagtywcyctcctmtcact

SEQ ID NO: 3575 - DNA, 30 bp, Artificial Sequence
  Description of Artificial Sequence: Synthetic oligonucleotide
cagcagbhcvrmagtywcyctcctwggact

SEQ ID NO: 3576 - DNA, 30 bp, Artificial Sequence
  Description of Artificial Sequence: Synthetic oligonucleotide
cagcagtacvrmmbcywcyctccttwcact

SEQ ID NO: 3577 - DNA, 30 bp, Artificial Sequence
  Description of Artificial Sequence: Synthetic oligonucleotide
cagcagtacvrmmbcywcyctcctmtcact

SEQ ID NO: 3578 - DNA, 30 bp, Artificial Sequence
  Description of Artificial Sequence: Synthetic oligonucleotide
cagcagtacvrmmbcywcyctcctwggact

SEQ ID NO: 3579 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctccttwcact

SEQ ID NO: 3580 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctcctmtcact

SEQ ID NO: 3581 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagrnanhcnhcttccctcctwggact

SEQ ID NO: 3582 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctccttwcact

SEQ ID NO: 3583 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctcctmtcact

SEQ ID NO: 3584 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (10)..(10): a, c, t or g
  misc_feature (10)..(10): n is a, c, g, or t
cagcagrnanhcagtywccctcctwggact

SEQ ID NO: 3585 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctccttwcact

SEQ ID NO: 3586 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctcctmtcact

SEQ ID NO: 3587 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcagrnaaatnhcywccctcctwggact

SEQ ID NO: 3588 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctccttwcact

SEQ ID NO: 3589 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctcctmtcact

SEQ ID NO: 3590 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcaggcanhcnhcywccctcctwggact

SEQ ID NO: 3591 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctccttwcact

SEQ ID NO: 3592 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctcctmtcact

SEQ ID NO: 3593 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhcctccctcctwggact

SEQ ID NO: 3594 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctccttwcact

SEQ ID NO: 3595 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctcctmtcact

SEQ ID NO: 3596 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
cagcagbhcnhcaatywccctcctwggact

SEQ ID NO: 3597 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctccttwcact

SEQ ID NO: 3598 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctcctmtcact

SEQ ID NO: 3599 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcgatnhcywccctcctwggact

SEQ ID NO: 3600 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctccttwcact

SEQ ID NO: 3601 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctcctmtcact

SEQ ID NO: 3602 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagtacnhcnhcywccctcctwggact

SEQ ID NO: 3603 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctccttwcact

SEQ ID NO: 3604 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctcctmtcact

SEQ ID NO: 3605 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnabhcnhcactcctcctwggact

SEQ ID NO: 3606 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctccttwcact

SEQ ID NO: 3607 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctcctmtcact

SEQ ID NO: 3608 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
cagcaavnabhcagtbhccctcctwggact

SEQ ID NO: 3609 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctccttwcact

SEQ ID NO: 3610 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctcctmtcact

SEQ ID NO: 3611 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (13)..(13): a, c, t or g
  misc_feature (13)..(13): n is a, c, g, or t
cagcaavnatacnhcbhccctcctwggact

SEQ ID NO: 3612 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctccttwcact

SEQ ID NO: 3613 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctcctmtcact

SEQ ID NO: 3614 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcaaagcbhcnhcbhccctcctwggact

SEQ ID NO: 3615 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctccttwcact

SEQ ID NO: 3616 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctcctmtcact

SEQ ID NO: 3617 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnasrmactcctcctwggact

SEQ ID NO: 3618 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctccttwcact

SEQ ID NO: 3619 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctcctmtcact

SEQ ID NO: 3620 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
  modified_base (11)..(11): a, c, t or g
  misc_feature (11)..(11): n is a, c, g, or t
atgcagvnamnacagvbccctcctwggact

SEQ ID NO: 3621 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctccttwcact

SEQ ID NO: 3622 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctcctmtcact

SEQ ID NO: 3623 - DNA, 30 bp, Artificial Sequence
  Description of Artificial Sequence: Synthetic oligonucleotide
  modified_base (8)..(8): a, c, t or g
  misc_feature (8)..(8): n is a, c, g, or t
atgcagvnactcsrmvbccctcctwggact

SEQ ID NO: 3624 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctccttwcact

SEQ ID NO: 3625 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctcctmtcact

SEQ ID NO: 3626 - DNA, 30 bp, Artificial Sequence
  Description of Artificial Sequence: Synthetic oligonucleotide
  modified_base (11)..(11): a, c, t or g
  misc_feature (11)..(11): n is a, c, g, or t
atgcaggcamnasrmvbccctcctwggact

SEQ ID NO: 3627 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctccttwcact

SEQ ID NO: 3628 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctcctmtcact

SEQ ID NO: 3629 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagbhcnhcnhctggcctcctwggact

SEQ ID NO: 3630 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctccttwcact

SEQ ID NO: 3631 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctcctmtcact

SEQ ID NO: 3632 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcagtnhcywccctcctwggact

SEQ ID NO: 3633 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctccttwcact

SEQ ID NO: 3634 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctcctmtcact

SEQ ID NO: 3635 - DNA, 30 bp, Artificial Sequence
  Description of Artificial Sequence: Synthetic oligonucleotide
  modified_base (10)..(10): a, c, t or g
  misc_feature (10)..(10): n is a, c, g, or t
  modified_base (13)..(13): a, c, t or g
  misc_feature (13)..(13): n is a, c, g, or t
cagcagaganhcnhcywccctcctwggact

SEQ ID NO: 3636 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctccttwcact

SEQ ID NO: 3637 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctcctmtcact

SEQ ID NO: 3638 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcaatnhcywccctcctwggact

SEQ ID NO: 3639 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctccttwcact

SEQ ID NO: 3640 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctcctmtcact

SEQ ID NO: 3641 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcbhcvncagtcctcctwggact

SEQ ID NO: 3642 - DNA, 30 bp, Artificial Sequence
  Description of Artificial Sequence: Synthetic oligonucleotide
cagcagbhcbhcagtbhccctccttwcact

SEQ ID NO: 3643 - DNA, 30 bp, Artificial Sequence
  Description of Artificial Sequence: Synthetic oligonucleotide
cagcagbhcbhcagtbhccctcctmtcact

SEQ ID NO: 3644 - DNA, 30 bp, Artificial Sequence
  Description of Artificial Sequence: Synthetic oligonucleotide
cagcagbhcbhcagtbhccctcctwggact

SEQ ID NO: 3645 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctccttwcact

SEQ ID NO: 3646 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctcctmtcact

SEQ ID NO: 3647 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagbhcggavncbhccctcctwggact

SEQ ID NO: 3648 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctccttwcact

SEQ ID NO: 3649 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctcctmtcact

SEQ ID NO: 3650 - DNA, 30 bp, Artificial Sequence
  Description of Artificial Sequence: Synthetic oligonucleotide
  modified_base (14)..(14): a, c, t or g
  misc_feature (14)..(14): n is a, c, g, or t
cagcagtacbhcvncbhccctcctwggact

SEQ ID NO: 3651 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctccttwcact

SEQ ID NO: 3652 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctcctmtcact

SEQ ID NO: 3653 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhcbhcnhcactcctcctwggact

SEQ ID NO: 3654 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctccttwcact

SEQ ID NO: 3655 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctcctmtcact

SEQ ID NO: 3656 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagbhctacnhcbhccctcctwggact

SEQ ID NO: 3657 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctccttwcact

SEQ ID NO: 3658 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctcctmtcact

SEQ ID NO: 3659 - DNA, 30 bp, Artificial Sequence
  Description of Artificial Sequence: Synthetic oligonucleotide
  modified_base (13)..(13): a, c, t or g
  misc_feature (13)..(13): n is a, c, g, or t
cagcagtacbhcnhcbhccctcctwggact

SEQ ID NO: 3660 - protein, 8 aa, Artificial Sequence
  Description of Artificial Sequence: Synthetic peptide
RTAHHFDY

SEQ ID NO: 3661 - protein, 9 aa, Artificial Sequence
  Description of Artificial Sequence: Synthetic peptide
VGIVGAASY

SEQ ID NO: 3662 - protein, 10 aa, Artificial Sequence
  Description of Artificial Sequence: Synthetic peptide
DRYSGHDLGY

SEQ ID NO: 3663 - protein, 12 aa, Artificial Sequence
  Description of Artificial Sequence: Synthetic peptide
GIAAADSNWLDP

SEQ ID NO: 3664 - protein, 16 aa, Artificial Sequence
  Description of Artificial Sequence: Synthetic peptide
ERTINWGWGGVYAFDI

SEQ ID NO: 3665 - protein, 4 aa, Artificial Sequence
  Description of Artificial Sequence: Synthetic peptide
EAGG

SEQ ID NO: 3666 - protein, 4 aa, Artificial Sequence
  Description of Artificial Sequence: Synthetic peptide
DAGG

SEQ ID NO: 3667 - protein, 4 aa, Artificial Sequence
  Description of Artificial Sequence: Synthetic peptide
GAGG

SEQ ID NO: 3668 - protein, 4 aa, Artificial Sequence
  Description of Artificial Sequence: Synthetic peptide
EGAG

SEQ ID NO: 3669 - protein, 4 aa, Artificial Sequence
  Description of Artificial Sequence: Synthetic peptide
DGAG

SEQ ID NO: 3670 - protein, 4 aa, Artificial Sequence
  Description of Artificial Sequence: Synthetic peptide
GGAG

SEQ ID NO: 3671 - protein, 4 aa, Artificial Sequence
  Description of Artificial Sequence: Synthetic peptide
EGGA

SEQ ID NO: 3672 - protein, 4 aa, Artificial Sequence
  Description of Artificial Sequence: Synthetic peptide
DGGA

SEQ ID NO: 3673 - protein, 4 aa, Artificial Sequence
  Description of Artificial Sequence: Synthetic peptide
GGGA

SEQ ID NO: 3674 - protein, 4 aa, Artificial Sequence
  Description of Artificial Sequence: Synthetic peptide
EGGG

SEQ ID NO: 3675 - protein, 4 aa, Artificial Sequence
  Description of Artificial Sequence: Synthetic peptide
DGGG

SEQ ID NO: 3676 - protein, 4 aa, Artificial Sequence
  Description of Artificial Sequence: Synthetic peptide
GGGG

SEQ ID NO: 3677 - protein, 4 aa, Artificial Sequence
  Description of Artificial Sequence: Synthetic peptide
EGGL

SEQ ID NO: 3678 - protein, 4 aa, Artificial Sequence
  Description of Artificial Sequence: Synthetic peptide
DGGL

SEQ ID NO: 3679 - protein, 4 aa, Artificial Sequence
  Description of Artificial Sequence: Synthetic peptide
GGGL

SEQ ID NO: 3680 - protein, 4 aa, Artificial Sequence
  Description of Artificial Sequence: Synthetic peptide
EGGP

SEQ ID NO: 3681 - protein, 4 aa, Artificial Sequence
  Description of Artificial Sequence: Synthetic peptide
DGGP

SEQ ID NO: 3682 - protein, 4 aa, Artificial Sequence
  Description of Artificial Sequence: Synthetic peptide
GGGP

SEQ ID NO: 3683 - protein, 4 aa, Artificial Sequence
  Description of Artificial Sequence: Synthetic peptide
EGGR

SEQ ID NO: 3684 - protein, 4 aa, Artificial Sequence
  Description of Artificial Sequence: Synthetic peptide
DGGR

SEQ ID NO: 3685 - protein, 4 aa, Artificial Sequence
  Description of Artificial Sequence: Synthetic peptide
GGGR

SEQ ID NO: 3686 - protein, 4 aa, Artificial Sequence
  Description of Artificial Sequence: Synthetic peptide
EGGS

SEQ ID NO: 3687 - protein, 4 aa, Artificial Sequence
  Description of Artificial Sequence: Synthetic peptide
DGGS

SEQ ID NO: 3688 - protein, 4 aa, Artificial Sequence
  Description of Artificial Sequence: Synthetic peptide
GGGS

SEQ ID NO: 3689 - protein, 4 aa, Artificial Sequence
  Description of Artificial Sequence: Synthetic peptide
EGGT

SEQ ID NO: 3690 - protein, 4 aa, Artificial Sequence
  Description of Artificial Sequence: Synthetic peptide
DGGT

SEQ ID NO: 3691 - protein, 4 aa, Artificial Sequence
  Description of Artificial Sequence: Synthetic peptide
GGGT

SEQ ID NO: 3692 - protein, 4 aa, Artificial Sequence
  Description of Artificial Sequence: Synthetic peptide
EGGV

SEQ ID NO: 3693 - protein, 4 aa, Artificial Sequence
  Description of Artificial Sequence: Synthetic peptide
DGGV

SEQ ID NO: 3694 - protein, 4 aa, Artificial Sequence
  Description of Artificial Sequence: Synthetic peptide
GGGV

SEQ ID NO: 3695 - protein, 4 aa, Artificial Sequence
  Description of Artificial Sequence: Synthetic peptide
EGLG

SEQ ID NO: 3696 - protein, 4 aa, Artificial Sequence
  Description of Artificial Sequence: Synthetic peptide
DGLG

SEQ ID NO: 3697 - protein, 4 aa, Artificial Sequence
  Description of Artificial Sequence: Synthetic peptide
GGLG

SEQ ID NO: 3698 - protein, 4 aa, Artificial Sequence
  Description of Artificial Sequence: Synthetic peptide
EGPG

SEQ ID NO: 3699 - protein, 4 aa, Artificial Sequence
  Description of Artificial Sequence: Synthetic peptide
DGPG

SEQ ID NO: 3700 - protein, 4 aa, Artificial Sequence
  Description of Artificial Sequence: Synthetic peptide
GGPG

SEQ ID NO: 3701 - protein, 4 aa, Artificial Sequence
  Description of Artificial Sequence: Synthetic peptide
EGRG

SEQ ID NO: 3702 - protein, 4 aa, Artificial Sequence
  Description of Artificial Sequence: Synthetic peptide
DGRG

SEQ ID NO: 3703 - protein, 4 aa, Artificial Sequence
  Description of Artificial Sequence: Synthetic peptide
GGRG

SEQ ID NO: 3704 - protein, 4 aa, Artificial Sequence
  Description of Artificial Sequence: Synthetic peptide
EGSG

SEQ ID NO: 3705 - protein, 4 aa, Artificial Sequence
  Description of Artificial Sequence: Synthetic peptide
DGSG

SEQ ID NO: 3706 - protein, 4 aa, Artificial Sequence
  Description of Artificial Sequence: Synthetic peptide
GGSG

SEQ ID NO: 3707 - protein, 4 aa, Artificial Sequence
  Description of Artificial Sequence: Synthetic peptide
EGTG

SEQ ID NO: 3708 - protein, 4 aa, Artificial Sequence
  Description of Artificial Sequence: Synthetic peptide
DGTG

SEQ ID NO: 3709 - protein, 4 aa, Artificial Sequence
  Description of Artificial Sequence: Synthetic peptide
GGTG

SEQ ID NO: 3710 - protein, 4 aa, Artificial Sequence
  Description of Artificial Sequence: Synthetic peptide
EGVG

SEQ ID NO: 3711 - protein, 4 aa, Artificial Sequence
  Description of Artificial Sequence: Synthetic peptide
DGVG

SEQ ID NO: 3712 - protein, 4 aa, Artificial Sequence
  Description of Artificial Sequence: Synthetic peptide
GGVG

SEQ ID NO: 3713 - protein, 4 aa, Artificial Sequence
  Description of Artificial Sequence: Synthetic peptide
ELGG

SEQ ID NO: 3714 - protein, 4 aa, Artificial Sequence
  Description of Artificial Sequence: Synthetic peptide
DLGG

SEQ ID NO: 3715 - protein, 4 aa, Artificial Sequence
  Description of Artificial Sequence: Synthetic peptide
GLGG

SEQ ID NO: 3716 - protein, 4 aa, Artificial Sequence
  Description of Artificial Sequence: Synthetic peptide
EPGG

SEQ ID NO: 3717 - protein, 4 aa, Artificial Sequence
  Description of Artificial Sequence: Synthetic peptide
DPGG

SEQ ID NO: 3718 - protein, 4 aa, Artificial Sequence
  Description of Artificial Sequence: Synthetic peptide
GPGG

SEQ ID NO: 3719 - protein, 4 aa, Artificial Sequence
  Description of Artificial Sequence: Synthetic peptide
ERGG

SEQ ID NO: 3720 - protein, 4 aa, Artificial Sequence
  Description of Artificial Sequence: Synthetic peptide
DRGG

SEQ ID NO: 3721 - protein, 4 aa, Artificial Sequence
  Description of Artificial Sequence: Synthetic peptide
GRGG

SEQ ID NO: 3722 - protein, 4 aa, Artificial Sequence
  Description of Artificial Sequence: Synthetic peptide
ESGG

SEQ ID NO: 3723 - protein, 4 aa, Artificial Sequence
  Description of Artificial Sequence: Synthetic peptide
DSGG

SEQ ID NO: 3724 - protein, 4 aa, Artificial Sequence
  Description of Artificial Sequence: Synthetic peptide
GSGG

SEQ ID NO: 3725 - protein, 4 aa, Artificial Sequence
  Description of Artificial Sequence: Synthetic peptide
ETGG

SEQ ID NO: 3726 - protein, 4 aa, Artificial Sequence
  Description of Artificial Sequence: Synthetic peptide
DTGG

SEQ ID NO: 3727 - protein, 4 aa, Artificial Sequence
  Description of Artificial Sequence: Synthetic peptide
GTGG

SEQ ID NO: 3728 - protein, 4 aa, Artificial Sequence
  Description of Artificial Sequence: Synthetic peptide
EVGG

SEQ ID NO: 3729 - protein, 4 aa, Artificial Sequence
  Description of Artificial Sequence: Synthetic peptide
DVGG

SEQ ID NO: 3730 - protein, 4 aa, Artificial Sequence
  Description of Artificial Sequence: Synthetic peptide
GVGG

SEQ ID NO: 3731 - protein, 6 aa, Artificial Sequence
  Description of Artificial Sequence: Synthetic peptide
GTTGTT

SEQ ID NO: 3732 - protein, 5 aa, Artificial Sequence
  Description of Artificial Sequence: Synthetic peptide
GTTGT

SEQ ID NO: 3733 - protein, 5 aa, Artificial Sequence
  Description of Artificial Sequence: Synthetic peptide
TTGTT

SEQ ID NO: 3734 - protein, 4 aa, Artificial Sequence
  Description of Artificial Sequence: Synthetic peptide
GTTG

SEQ ID NO: 3735 - protein, 4 aa, Artificial Sequence
  Description of Artificial Sequence: Synthetic peptide
TTGT

SEQ ID NO: 3736 - protein, 4 aa, Artificial Sequence
  Description of Artificial Sequence: Synthetic peptide
TGTT

SEQ ID NO: 3737 - protein, 5 aa, Artificial Sequence
  Description of Artificial Sequence: Synthetic peptide
VQLER

SEQ ID NO: 3738 - protein, 4 aa, Artificial Sequence
  Description of Artificial Sequence: Synthetic peptide
VQLE

SEQ ID NO: 3739 - protein, 4 aa, Artificial Sequence
  Description of Artificial Sequence: Synthetic peptide
QLER

SEQ ID NO: 3740 - protein, 5 aa, Artificial Sequence
  Description of Artificial Sequence: Synthetic peptide
YNWND

SEQ ID NO: 3741 - protein, 4 aa, Artificial Sequence
  Description of Artificial Sequence: Synthetic peptide
YNWN

SEQ ID NO: 3742 - protein, 4 aa, Artificial Sequence
  Description of Artificial Sequence: Synthetic peptide
NWND

SEQ ID NO: 3743 - protein, 6 aa, Artificial Sequence
  Description of Artificial Sequence: Synthetic peptide
GITGTT

SEQ ID NO: 3744 - protein, 5 aa, Artificial Sequence
  Description of Artificial Sequence: Synthetic peptide
GITGT

SEQ ID NO: 3745 - protein, 5 aa, Artificial Sequence
  Description of Artificial Sequence: Synthetic peptide
ITGTT

SEQ ID NO: 3746 - protein, 4 aa, Artificial Sequence
  Description of Artificial Sequence: Synthetic peptide
GITG

SEQ ID NO: 3747 - protein, 4 aa, Artificial Sequence
  Description of Artificial Sequence: Synthetic peptide
ITGT

SEQ ID NO: 3748 - protein, 7 aa, Artificial Sequence
  Description of Artificial Sequence: Synthetic peptide
GIVGATT

SEQ ID NO: 3749 - protein, 6 aa, Artificial Sequence
  Description of Artificial Sequence: Synthetic peptide
GIVGAT

SEQ ID NO: 3750 - protein, 6 aa, Artificial Sequence
  Description of Artificial Sequence: Synthetic peptide
IVGATT

SEQ ID NO: 3751 - protein, 5 aa, Artificial Sequence
  Description of Artificial Sequence: Synthetic peptide
GIVGA

SEQ ID NO: 3752 - protein, 5 aa, Artificial Sequence
  Description of Artificial Sequence: Synthetic peptide
IVGAT

SEQ ID NO: 3753 - protein, 5 aa, Artificial Sequence
  Description of Artificial Sequence: Synthetic peptide
VGATT

SEQ ID NO: 3754 - protein, 4 aa, Artificial Sequence
  Description of Artificial Sequence: Synthetic peptide
GIVG

SEQ ID NO: 3755 - protein, 4 aa, Artificial Sequence
  Description of Artificial Sequence: Synthetic peptide
IVGA

SEQ ID NO: 3756 - protein, 4 aa, Artificial Sequence
  Description of Artificial Sequence: Synthetic peptide
VGAT

SEQ ID NO: 3757 - protein, 4 aa, Artificial Sequence
  Description of Artificial Sequence: Synthetic peptide
GATT

SEQ ID NO: 3758 - protein, 4 aa, Artificial Sequence
  Description of Artificial Sequence: Synthetic peptide
WELL

SEQ ID NO: 3759 - protein, 6 aa, Artificial Sequence
  Description of Artificial Sequence: Synthetic peptide
YSGSYY

SEQ ID NO: 3760 - protein, 5 aa, Artificial Sequence
  Description of Artificial Sequence: Synthetic peptide
YSGSY

SEQ ID NO: 3761 - protein, 5 aa, Artificial Sequence
  Description of Artificial Sequence: Synthetic peptide
SGSYY

SEQ ID NO: 3762 - protein, 4 aa, Artificial Sequence
  Description of Artificial Sequence: Synthetic peptide
YSGS

SEQ ID NO: 3763 - protein, 4 aa, Artificial Sequence
  Description of Artificial Sequence: Synthetic peptide
SGSY

SEQ ID NO: 3764 - protein, 4 aa, Artificial Sequence
  Description of Artificial Sequence: Synthetic peptide
GSYY

SEQ ID NO: 3765 - protein, 5 aa, Artificial Sequence
  Description of Artificial Sequence: Synthetic peptide
YNWNY

SEQ ID NO: 3766 - protein, 4 aa, Artificial Sequence
  Description of Artificial Sequence: Synthetic peptide
NWNY

SEQ ID NO: 3767 - protein, 10 aa, Artificial Sequence
  Description of Artificial Sequence: Synthetic peptide
GYCSGGSCYS

SEQ ID NO: 3768 - protein, 9 aa, Artificial Sequence
  Description of Artificial Sequence: Synthetic peptide
GYCSGGSCY

SEQ ID NO: 3769 - protein, 9 aa, Artificial Sequence
  Description of Artificial Sequence: Synthetic peptide
YCSGGSCYS

SEQ ID NO: 3770 - protein, 8 aa, Artificial Sequence
  Description of Artificial Sequence: Synthetic peptide
GYCSGGSC

SEQ ID NO: 3771 - protein, 8 aa, Artificial Sequence
  Description of Artificial Sequence: Synthetic peptide
YCSGGSCY

SEQ ID NO: 3772 - protein, 8 aa, Artificial Sequence
  Description of Artificial Sequence: Synthetic peptide
CSGGSCYS

SEQ ID NO: 3773 - protein, 7 aa, Artificial Sequence
  Description of Artificial Sequence: Synthetic peptide
YCSGGSC

SEQ ID NO: 3774 - protein, 7 aa, Artificial Sequence
  Description of Artificial Sequence: Synthetic peptide
CSGGSCY

SEQ ID NO: 3775 - protein, 6 aa, Artificial Sequence
  Description of Artificial Sequence: Synthetic peptide
CSGGSC

SEQ ID NO: 3776 - protein, 4 aa, Artificial Sequence
  Description of Artificial Sequence: Synthetic peptide
SGGS

SEQ ID NO: 3777 - protein, 10 aa, Artificial Sequence
  Description of Artificial Sequence: Synthetic peptide
DIVVVVAATP

SEQ ID NO: 3778 - protein, 9 aa, Artificial Sequence
  Description of Artificial Sequence: Synthetic peptide
DIVVVVAAT

SEQ ID NO: 3779 - protein, 9 aa, Artificial Sequence
  Description of Artificial Sequence: Synthetic peptide
IVVVVAATP

SEQ ID NO: 3780 - protein, 8 aa, Artificial Sequence
  Description of Artificial Sequence: Synthetic peptide
DIVVVVAA

SEQ ID NO: 3781 - protein, 8 aa, Artificial Sequence
  Description of Artificial Sequence: Synthetic peptide
IVVVVAAT

SEQ ID NO: 3782 - protein, 8 aa, Artificial Sequence
  Description of Artificial Sequence: Synthetic peptide
VVVVAATP

SEQ ID NO: 3783 - protein, 7 aa, Artificial Sequence
  Description of Artificial Sequence: Synthetic peptide
DIVVVVA

SEQ ID NO: 3784 - protein, 7 aa, Artificial Sequence
  Description of Artificial Sequence: Synthetic peptide
IVVVVAA

SEQ ID NO: 3785 - protein, 7 aa, Artificial Sequence
  Description of Artificial Sequence: Synthetic peptide
VVVVAAT

SEQ ID NO: 3786 - protein, 7 aa, Artificial Sequence
  Description of Artificial Sequence: Synthetic peptide
VVVAATP

SEQ ID NO: 3787 - protein, 6 aa, Artificial Sequence
  Description of Artificial Sequence: Synthetic peptide
DIVVVV

SEQ ID NO: 3788 - protein, 6 aa, Artificial Sequence
  Description of Artificial Sequence: Synthetic peptide
IVVVVA

SEQ ID NO: 3789 - protein, 6 aa, Artificial Sequence
  Description of Artificial Sequence: Synthetic peptide
VVVVAA

SEQ ID NO: 3790 - protein, 6 aa, Artificial Sequence
  Description of Artificial Sequence: Synthetic peptide
VVVAAT

SEQ ID NO: 3791 - protein, 6 aa, Artificial Sequence
  Description of Artificial Sequence: Synthetic peptide
VVAATP

SEQ ID NO: 3792 - protein, 5 aa, Artificial Sequence
  Description of Artificial Sequence: Synthetic peptide
DIVVV

SEQ ID NO: 3793 - protein, 5 aa, Artificial Sequence
  Description of Artificial Sequence: Synthetic peptide
IVVVV

SEQ ID NO: 3794 - protein, 5 aa, Artificial Sequence
  Description of Artificial Sequence: Synthetic peptide
VVVVA

SEQ ID NO: 3795 - protein, 5 aa, Artificial Sequence
  Description of Artificial Sequence: Synthetic peptide
VVVAA

SEQ ID NO: 3796 - protein, 5 aa, Artificial Sequence
  Description of Artificial Sequence: Synthetic peptide
VVAAT

SEQ ID NO: 3797 - protein, 5 aa, Artificial Sequence
  Description of Artificial Sequence: Synthetic peptide
VAATP

SEQ ID NO: 3798 - protein, 4 aa, Artificial Sequence
  Description of Artificial Sequence: Synthetic peptide
DIVV

SEQ ID NO: 3799 - protein, 4 aa, Artificial Sequence
  Description of Artificial Sequence: Synthetic peptide
IVVV

SEQ ID NO: 3800 - protein, 4 aa, Artificial Sequence
  Description of Artificial Sequence: Synthetic peptide
VVVV

SEQ ID NO: 3801 - protein, 4 aa, Artificial Sequence
  Description of Artificial Sequence: Synthetic peptide
VVVA

SEQ ID NO: 3802 - protein, 4 aa, Artificial Sequence
  Description of Artificial Sequence: Synthetic peptide
VVAA

SEQ ID NO: 3803 - protein, 4 aa, Artificial Sequence
  Description of Artificial Sequence: Synthetic peptide
VAAT

SEQ ID NO: 3804 - protein, 4 aa, Artificial Sequence
  Description of Artificial Sequence: Synthetic peptide
AATP

SEQ ID NO: 3805 - protein, 4 aa, Artificial Sequence
  Description of Artificial Sequence: Synthetic peptide
YQLL

SEQ ID NO: 3806 - protein, 10 aa, Artificial Sequence
  Description of Artificial Sequence: Synthetic peptide
GYCSSTSCYA

SEQ ID NO: 3807 - protein, 9 aa, Artificial Sequence
  Description of Artificial Sequence: Synthetic peptide
GYCSSTSCY

SEQ ID NO: 3808 - protein, 9 aa, Artificial Sequence
  Description of Artificial Sequence: Synthetic peptide
YCSSTSCYA

SEQ ID NO: 3809 - protein, 8 aa, Artificial Sequence
  Description of Artificial Sequence: Synthetic peptide
GYCSSTSC

SEQ ID NO: 3810 - protein, 8 aa, Artificial Sequence
  Description of Artificial Sequence: Synthetic peptide
YCSSTSCY

SEQ ID NO: 3811 - protein, 8 aa, Artificial Sequence
  Description of Artificial Sequence: Synthetic peptide
CSSTSCYA

SEQ ID NO: 3812 - protein, 7 aa, Artificial Sequence
  Description of Artificial Sequence: Synthetic peptide
YCSSTSC

SEQ ID NO: 3813 - protein, 7 aa, Artificial Sequence
  Description of Artificial Sequence: Synthetic peptide
CSSTSCY

SEQ ID NO: 3814 - protein, 6 aa, Artificial Sequence
  Description of Artificial Sequence: Synthetic peptide
CSSTSC

SEQ ID NO: 3815 - protein, 4 aa, Artificial Sequence
  Description of Artificial Sequence: Synthetic peptide
SSTS

SEQ ID NO: 3816 - protein, 10 aa, Artificial Sequence
  Description of Artificial Sequence: Synthetic peptide
DIVVVPAAMP

SEQ ID NO: 3817 - protein, 9 aa, Artificial Sequence
  Description of Artificial Sequence: Synthetic peptide
DIVVVPAAM

SEQ ID NO: 3818 - protein, 9 aa, Artificial Sequence
  Description of Artificial Sequence: Synthetic peptide
IVVVPAAMP

SEQ ID NO: 3819 - protein, 8 aa, Artificial Sequence
  Description of Artificial Sequence: Synthetic peptide
DIVVVPAA

SEQ ID NO: 3820 - protein, 8 aa, Artificial Sequence
  Description of Artificial Sequence: Synthetic peptide
IVVVPAAM

SEQ ID NO: 3821 - protein, 8 aa, Artificial Sequence
  Description of Artificial Sequence: Synthetic peptide
VVVPAAMP

SEQ ID NO: 3822 - protein, 7 aa, Artificial Sequence
  Description of Artificial Sequence: Synthetic peptide
DIVVVPA

SEQ ID NO: 3823 - protein, 7 aa, Artificial Sequence
  Description of Artificial Sequence: Synthetic peptide
IVVVPAA

SEQ ID NO: 3824 - protein, 7 aa, Artificial Sequence
  Description of Artificial Sequence: Synthetic peptide
VVVPAAM

SEQ ID NO: 3825 - protein, 7 aa, Artificial Sequence
  Description of Artificial Sequence: Synthetic peptide
VVPAAMP

SEQ ID NO: 3826 - protein, 6 aa, Artificial Sequence
  Description of Artificial Sequence: Synthetic peptide
DIVVVP

SEQ ID NO: 3827 - protein, 6 aa, Artificial Sequence
  Description of Artificial Sequence: Synthetic peptide
IVVVPA

SEQ ID NO: 3828 - protein, 6 aa, Artificial Sequence
  Description of Artificial Sequence: Synthetic peptide
VVVPAA

SEQ ID NO: 3829 - protein, 6 aa, Artificial Sequence
  Description of Artificial Sequence: Synthetic peptide
VVPAAM

SEQ ID NO: 3830 - protein, 6 aa, Artificial Sequence
  Description of Artificial Sequence: Synthetic peptide
VPAAMP

SEQ ID NO: 3831 - protein, 5 aa, Artificial Sequence
  Description of Artificial Sequence: Synthetic peptide
IVVVP

SEQ ID NO: 3832 - protein, 5 aa, Artificial Sequence
  Description of Artificial Sequence: Synthetic peptide
VVVPA

SEQ ID NO: 3833 - protein, 5 aa, Artificial Sequence
  Description of Artificial Sequence: Synthetic peptide
VVPAA

SEQ ID NO: 3834 - protein, 5 aa, Artificial Sequence
  Description of Artificial Sequence: Synthetic peptide
VPAAM

SEQ ID NO: 3835 - protein, 5 aa, Artificial Sequence
  Description of Artificial Sequence: Synthetic peptide
PAAMP

SEQ ID NO: 3836 - protein, 4 aa, Artificial Sequence
  Description of Artificial Sequence: Synthetic peptide
VVVP

SEQ ID NO: 3837 - protein, 4 aa, Artificial Sequence
  Description of Artificial Sequence: Synthetic peptide
VVPA

SEQ ID NO: 3838 - protein, 4 aa, Artificial Sequence
  Description of Artificial Sequence: Synthetic peptide
VPAA

SEQ ID NO: 3839 - protein, 4 aa, Artificial Sequence
  Description of Artificial Sequence: Synthetic peptide
PAAM

SEQ ID NO: 3840 - protein, 4 aa, Artificial Sequence
  Description of Artificial Sequence: Synthetic peptide
AAMP

SEQ ID NO: 3841 - protein, 5 aa, Artificial Sequence
  Description of Artificial Sequence: Synthetic peptide
YQLLY

SEQ ID NO: 3842 - protein, 4 aa, Artificial Sequence
  Description of Artificial Sequence: Synthetic peptide
QLLY

SEQ ID NO: 3843 - protein, 10 aa, Artificial Sequence
  Description of Artificial Sequence: Synthetic peptide
GYCSSTSCYT

SEQ ID NO: 3844 - protein, 9 aa, Artificial Sequence
  Description of Artificial Sequence: Synthetic peptide
YCSSTSCYT

SEQ ID NO: 3845 - protein, 8 aa, Artificial Sequence
  Description of Artificial Sequence: Synthetic peptide
CSSTSCYT

SEQ ID NO: 3846 - protein, 10 aa, Artificial Sequence
  Description of Artificial Sequence: Synthetic peptide
DIVVVPAAIP

SEQ ID NO: 3847 - protein, 9 aa, Artificial Sequence
  Description of Artificial Sequence: Synthetic peptide
DIVVVPAAI

SEQ ID NO: 3848 - protein, 9 aa, Artificial Sequence
  Description of Artificial Sequence: Synthetic peptide
IVVVPAAIP

SEQ ID NO: 3849 - protein, 8 aa, Artificial Sequence
  Description of Artificial Sequence: Synthetic peptide
IVVVPAAI

SEQ ID NO: 3850 - protein, 8 aa, Artificial Sequence
  Description of Artificial Sequence: Synthetic peptide
VVVPAAIP

SEQ ID NO: 3851 - protein, 7 aa, Artificial Sequence
  Description of Artificial Sequence: Synthetic peptide
VVVPAAI

SEQ ID NO: 3852 - protein, 7 aa, Artificial Sequence
  Description of Artificial Sequence: Synthetic peptide
VVPAAIP

SEQ ID NO: 3853 - protein, 6 aa, Artificial Sequence
  Description of Artificial Sequence: Synthetic peptide
VVPAAI

SEQ ID NO: 3854 - protein, 6 aa, Artificial Sequence
  Description of Artificial Sequence: Synthetic peptide
VPAAIP

SEQ ID NO: 3855 - protein, 5 aa, Artificial Sequence
  Description of Artificial Sequence: Synthetic peptide
VPAAI

SEQ ID NO: 3856 - protein, 5 aa, Artificial Sequence
  Description of Artificial Sequence: Synthetic peptide
PAAIP

SEQ ID NO: 3857 - protein, 4 aa, Artificial Sequence
  Description of Artificial Sequence: Synthetic peptide
PAAI

SEQ ID NO: 3858 - protein, 4 aa, Artificial Sequence
  Description of Artificial Sequence: Synthetic peptide
AAIP

SEQ ID NO: 3859 - protein, 5 aa, Artificial Sequence
  Description of Artificial Sequence: Synthetic peptide
SILWW

SEQ ID NO: 3860 - protein, 4 aa, Artificial Sequence
  Description of Artificial Sequence: Synthetic peptide
SILW

SEQ ID NO: 3861 - protein, 4 aa, Artificial Sequence
  Description of Artificial Sequence: Synthetic peptide
ILWW

SEQ ID NO: 3862 - protein, 9 aa, Artificial Sequence
  Description of Artificial Sequence: Synthetic peptide
AYCGGDCYS

SEQ ID NO: 3863 - protein, 8 aa, Artificial Sequence
  Description of Artificial Sequence: Synthetic peptide
AYCGGDCY

SEQ ID NO: 3864 - protein, 8 aa, Artificial Sequence
  Description of Artificial Sequence: Synthetic peptide
YCGGDCYS

SEQ ID NO: 3865 - protein, 7 aa, Artificial Sequence
  Description of Artificial Sequence: Synthetic peptide
AYCGGDC

SEQ ID NO: 3866 - protein, 7 aa, Artificial Sequence
  Description of Artificial Sequence: Synthetic peptide
YCGGDCY

SEQ ID NO: 3867 - protein, 7 aa, Artificial Sequence
  Description of Artificial Sequence: Synthetic peptide
CGGDCYS

SEQ ID NO: 3868 - protein, 6 aa, Artificial Sequence
  Description of Artificial Sequence: Synthetic peptide
YCGGDC

SEQ ID NO: 3869 - protein, 6 aa, Artificial Sequence
  Description of Artificial Sequence: Synthetic peptide
CGGDCY

SEQ ID NO: 3870 - protein, 5 aa, Artificial Sequence
  Description of Artificial Sequence: Synthetic peptide
CGGDC

SEQ ID NO: 3871 - protein, 9 aa, Artificial Sequence
  Description of Artificial Sequence: Synthetic peptide
HIVVVIAIP

SEQ ID NO: 3872 - protein, 8 aa, Artificial Sequence
  Description of Artificial Sequence: Synthetic peptide
HIVVVIAI

SEQ ID NO: 3873 - protein, 8 aa, Artificial Sequence
  Description of Artificial Sequence: Synthetic peptide
IVVVIAIP

SEQ ID NO: 3874 - protein, 7 aa, Artificial Sequence
  Description of Artificial Sequence: Synthetic peptide
HIVVVIA

SEQ ID NO: 3875 - protein, 7 aa, Artificial Sequence
  Description of Artificial Sequence: Synthetic peptide
IVVVIAI

SEQ ID NO: 3876 - protein, 7 aa, Artificial Sequence
  Description of Artificial Sequence: Synthetic peptide
VVVIAIP

SEQ ID NO: 3877 - protein, 6 aa, Artificial Sequence
  Description of Artificial Sequence: Synthetic peptide
HIVVVI

SEQ ID NO: 3878 - protein, 6 aa, Artificial Sequence
  Description of Artificial Sequence: Synthetic peptide
IVVVIA

SEQ ID NO: 3879 - protein, 6 aa, Artificial Sequence
  Description of Artificial Sequence: Synthetic peptide
VVVIAI

SEQ ID NO: 3880 - protein, 6 aa, Artificial Sequence
  Description of Artificial Sequence: Synthetic peptide
VVIAIP

SEQ ID NO: 3881 - protein, 5 aa, Artificial Sequence
  Description of Artificial Sequence: Synthetic peptide
HIVVV

SEQ ID NO: 3882 - protein, 5 aa, Artificial Sequence
  Description of Artificial Sequence: Synthetic peptide
IVVVI

SEQ ID NO: 3883 - protein, 5 aa, Artificial Sequence
  Description of Artificial Sequence: Synthetic peptide
VVVIA

SEQ ID NO: 3884 - protein, 5 aa, Artificial Sequence
  Description of Artificial Sequence: Synthetic peptide
VVIAI

SEQ ID NO: 3885 - protein, 5 aa, Artificial Sequence
  Description of Artificial Sequence: Synthetic peptide
VIAIP

SEQ ID NO: 3886 - protein, 4 aa, Artificial Sequence
  Description of Artificial Sequence: Synthetic peptide
HIVV

SEQ ID NO: 3887 - protein, 4 aa, Artificial Sequence
  Description of Artificial Sequence: Synthetic peptide
VVVI

SEQ ID NO: 3888 - protein, 4 aa, Artificial Sequence
  Description of Artificial Sequence: Synthetic peptide
VVIA

SEQ ID NO: 3889 - protein, 4 aa, Artificial Sequence
  Description of Artificial Sequence: Synthetic peptide
VIAI

SEQ ID NO: 3890 - protein, 4 aa, Artificial Sequence
  Description of Artificial Sequence: Synthetic peptide
IAIP

SEQ ID NO: 3891 - protein, 9 aa, Artificial Sequence
  Description of Artificial Sequence: Synthetic peptide
HIVVVTAIP

SEQ ID NO: 3892 - protein, 8 aa, Artificial Sequence
  Description of Artificial Sequence: Synthetic peptide
HIVVVTAI

SEQ ID NO: 3893 - protein, 8 aa, Artificial Sequence
  Description of Artificial Sequence: Synthetic peptide
IVVVTAIP

SEQ ID NO: 3894 - protein, 7 aa, Artificial Sequence
  Description of Artificial Sequence: Synthetic peptide
HIVVVTA

SEQ ID NO: 3895 - protein, 7 aa, Artificial Sequence
  Description of Artificial Sequence: Synthetic peptide
IVVVTAI

SEQ ID NO: 3896 - protein, 7 aa, Artificial Sequence
  Description of Artificial Sequence: Synthetic peptide
VVVTAIP

SEQ ID NO: 3897 - protein, 6 aa, Artificial Sequence
  Description of Artificial Sequence: Synthetic peptide
HIVVVT

SEQ ID NO: 3898 - protein, 6 aa, Artificial Sequence
  Description of Artificial Sequence: Synthetic peptide
IVVVTA

SEQ ID NO: 3899 - protein, 6 aa, Artificial Sequence
  Description of Artificial Sequence: Synthetic peptide
VVVTAI

SEQ ID NO: 3900 - protein, 6 aa, Artificial Sequence
  Description of Artificial Sequence: Synthetic peptide
VVTAIP

SEQ ID NO: 3901 - protein, 5 aa, Artificial Sequence
  Description of Artificial Sequence: Synthetic peptide
IVVVT

SEQ ID NO: 3902 - protein, 5 aa, Artificial Sequence
  Description of Artificial Sequence: Synthetic peptide
VVVTA

SEQ ID NO: 3903 - protein, 5 aa, Artificial Sequence
  Description of Artificial Sequence: Synthetic peptide
VVTAI

SEQ ID NO: 3904 - protein, 5 aa, Artificial Sequence
  Description of Artificial Sequence: Synthetic peptide
VTAIP

SEQ ID NO: 3905 - protein, 4 aa, Artificial Sequence
  Description of Artificial Sequence: Synthetic peptide
VVVT

SEQ ID NO: 3906 - protein, 4 aa, Artificial Sequence
  Description of Artificial Sequence: Synthetic peptide
VVTA

SEQ ID NO: 3907 - protein, 4 aa, Artificial Sequence
  Description of Artificial Sequence: Synthetic peptide
VTAI

SEQ ID NO: 3908 - protein, 4 aa, Artificial Sequence
  Description of Artificial Sequence: Synthetic peptide
TAIP

SEQ ID NO: 3909 - protein, 4 aa, Artificial Sequence
  Description of Artificial Sequence: Synthetic peptide
RILY

SEQ ID NO: 3910 - protein, 10 aa, Artificial Sequence
  Description of Artificial Sequence: Synthetic peptide
GYCTNGVCYT

SEQ ID NO: 3911 - protein, 9 aa, Artificial Sequence
  Description of Artificial Sequence: Synthetic peptide
GYCTNGVCY

SEQ ID NO: 3912 - protein, 9 aa, Artificial Sequence
  Description of Artificial Sequence: Synthetic peptide
YCTNGVCYT

SEQ ID NO: 3913 - protein, 8 aa, Artificial Sequence
  Description of Artificial Sequence: Synthetic peptide
GYCTNGVC

SEQ ID NO: 3914 - protein, 8 aa, Artificial Sequence
  Description of Artificial Sequence: Synthetic peptide
YCTNGVCY

SEQ ID NO: 3915 - protein, 8 aa, Artificial Sequence
  Description of Artificial Sequence: Synthetic peptide
CTNGVCYT

SEQ ID NO: 3916 - protein, 7 aa, Artificial Sequence
  Description of Artificial Sequence: Synthetic peptide
YCTNGVC

SEQ ID NO: 3917 - protein, 7 aa, Artificial Sequence
  Description of Artificial Sequence: Synthetic peptide
CTNGVCY

SEQ ID NO: 3918 - protein, 6 aa, Artificial Sequence
  Description of Artificial Sequence: Synthetic peptide
CTNGVC

SEQ ID NO: 3919 - protein, 4 aa, Artificial Sequence
  Description of Artificial Sequence: Synthetic peptide
TNGV

SEQ ID NO: 3920 - protein, 10 aa, Artificial Sequence
  Description of Artificial Sequence: Synthetic peptide
DIVLMVYAIP

SEQ ID NO: 3921 - protein, 9 aa, Artificial Sequence
  Description of Artificial Sequence: Synthetic peptide
DIVLMVYAI

SEQ ID NO: 3922 - protein, 9 aa, Artificial Sequence
  Description of Artificial Sequence: Synthetic peptide
IVLMVYAIP

SEQ ID NO: 3923 - protein, 8 aa, Artificial Sequence
  Description of Artificial Sequence: Synthetic peptide
DIVLMVYA

SEQ ID NO: 3924 - protein, 8 aa, Artificial Sequence
  Description of Artificial Sequence: Synthetic peptide
IVLMVYAI

SEQ ID NO: 3925 - protein, 8 aa, Artificial Sequence
  Description of Artificial Sequence: Synthetic peptide
VLMVYAIP

SEQ ID NO: 3926 - protein, 7 aa, Artificial Sequence
  Description of Artificial Sequence: Synthetic peptide
DIVLMVY

SEQ ID NO: 3927 - protein, 7 aa, Artificial Sequence
  Description of Artificial Sequence: Synthetic peptide
IVLMVYA

SEQ ID NO: 3928 - protein, 7 aa, Artificial Sequence
  Description of Artificial Sequence: Synthetic peptide
VLMVYAI

SEQ ID NO: 3929 - protein, 7 aa, Artificial Sequence
  Description of Artificial Sequence: Synthetic peptide
LMVYAIP

SEQ ID NO: 3930 - protein, 6 aa, Artificial Sequence
  Description of Artificial Sequence: Synthetic peptide
DIVLMV

SEQ ID NO: 3931 - protein, 6 aa, Artificial Sequence
  Description of Artificial Sequence: Synthetic peptide
IVLMVY

SEQ ID NO: 3932 - protein, 6 aa, Artificial Sequence
  Description of Artificial Sequence: Synthetic peptide
VLMVYA

SEQ ID NO: 3933 - protein, 6 aa, Artificial Sequence
  Description of Artificial Sequence: Synthetic peptide
LMVYAI

SEQ ID NO: 3934 - protein, 6 aa, Artificial Sequence
  Description of Artificial Sequence: Synthetic peptide
MVYAIP

SEQ ID NO: 3935 - protein, 5 aa, Artificial Sequence
  Description of Artificial Sequence: Synthetic peptide
DIVLM

SEQ ID NO: 3936 - protein, 5 aa, Artificial Sequence
  Description of Artificial Sequence: Synthetic peptide
IVLMV

SEQ ID NO: 3937 - protein, 5 aa, Artificial Sequence
  Description of Artificial Sequence: Synthetic peptide
VLMVY

SEQ ID NO: 3938 - protein, 5 aa, Artificial Sequence
  Description of Artificial Sequence: Synthetic peptide
LMVYA

SEQ ID NO: 3939 - protein, 5 aa, Artificial Sequence
  Description of Artificial Sequence: Synthetic peptide
MVYAI

SEQ ID NO: 3940 - protein, 5 aa, Artificial Sequence
  Description of Artificial Sequence: Synthetic peptide
VYAIP

SEQ ID NO: 3941 - protein, 4 aa, Artificial Sequence
  Description of Artificial Sequence: Synthetic peptide
DIVL

SEQ ID NO: 3942 - protein, 4 aa, Artificial Sequence
  Description of Artificial Sequence: Synthetic peptide
IVLM

SEQ ID NO: 3943 - protein, 4 aa, Artificial Sequence
  Description of Artificial Sequence: Synthetic peptide
VLMV

SEQ ID NO: 3944 - protein, 4 aa, Artificial Sequence
  Description of Artificial Sequence: Synthetic peptide
LMVY

SEQ ID NO: 3945 - protein, 4 aa, Artificial Sequence
  Description of Artificial Sequence: Synthetic peptide
MVYA

SEQ ID NO: 3946 - protein, 4 aa, Artificial Sequence
  Description of Artificial Sequence: Synthetic peptide
VYAI

SEQ ID NO: 3947 - protein, 4 aa, Artificial Sequence
  Description of Artificial Sequence: Synthetic peptide
YAIP

SEQ ID NO: 3948 - protein, 9 aa, Artificial Sequence
  Description of Artificial Sequence: Synthetic peptide
VLLWFGELL

SEQ ID NO: 3949 - protein, 8 aa, Artificial Sequence
  Description of Artificial Sequence: Synthetic peptide
VLLWFGEL

SEQ ID NO: 3950 - protein, 8 aa, Artificial Sequence
  Description of Artificial Sequence: Synthetic peptide
LLWFGELL

SEQ ID NO: 3951 - protein, 7 aa, Artificial Sequence
  Description of Artificial Sequence: Synthetic peptide
VLLWFGE

SEQ ID NO: 3952 - protein, 7 aa, Artificial Sequence
  Description of Artificial Sequence: Synthetic peptide
LLWFGEL

SEQ ID NO: 3953 - protein, 7 aa, Artificial Sequence
  Description of Artificial Sequence: Synthetic peptide
LWFGELL

SEQ ID NO: 3954 - protein, 6 aa, Artificial Sequence
  Description of Artificial Sequence: Synthetic peptide
VLLWFG

SEQ ID NO: 3955 - protein, 6 aa, Artificial Sequence
  Description of Artificial Sequence: Synthetic peptide
LLWFGE

SEQ ID NO: 3956 - protein, 6 aa, Artificial Sequence
  Description of Artificial Sequence: Synthetic peptide
LWFGEL

SEQ ID NO: 3957 - protein, 6 aa, Artificial Sequence
  Description of Artificial Sequence: Synthetic peptide
WFGELL

SEQ ID NO: 3958 - protein, 5 aa, Artificial Sequence
  Description of Artificial Sequence: Synthetic peptide
VLLWF

SEQ ID NO: 3959 - protein, 5 aa, Artificial Sequence
  Description of Artificial Sequence: Synthetic peptide
LLWFG

SEQ ID NO: 3960 - protein, 5 aa, Artificial Sequence
  Description of Artificial Sequence: Synthetic peptide
LWFGE

SEQ ID NO: 3961 - protein, 5 aa, Artificial Sequence
  Description of Artificial Sequence: Synthetic peptide
WFGEL

SEQ ID NO: 3962 - protein, 5 aa, Artificial Sequence
  Description of Artificial Sequence: Synthetic peptide
FGELL

SEQ ID NO: 3963 - protein, 4 aa, Artificial Sequence
  Description of Artificial Sequence: Synthetic peptide
VLLW

SEQ ID NO: 3964 - protein, 4 aa, Artificial Sequence
  Description of Artificial Sequence: Synthetic peptide
LLWF

SEQ ID NO: 3965 - protein, 4 aa, Artificial Sequence
  Description of Artificial Sequence: Synthetic peptide
LWFG

SEQ ID NO: 3966 - protein, 4 aa, Artificial Sequence
  Description of Artificial Sequence: Synthetic peptide
WFGE

SEQ ID NO: 3967 - protein, 4 aa, Artificial Sequence
  Description of Artificial Sequence: Synthetic peptide
FGEL

SEQ ID NO: 3968 - protein, 4 aa, Artificial Sequence
  Description of Artificial Sequence: Synthetic peptide
GELL

SEQ ID NO: 3969 - protein, 10 aa, Artificial Sequence
  Description of Artificial Sequence: Synthetic peptide
YYYGSGSYYN

SEQ ID NO: 3970 - protein, 9 aa, Artificial Sequence
  Description of Artificial Sequence: Synthetic peptide
YYYGSGSYY

SEQ ID NO: 3971 - protein, 9 aa, Artificial Sequence
  Description of Artificial Sequence: Synthetic peptide
YYGSGSYYN

SEQ ID NO: 3972 - protein, 8 aa, Artificial Sequence
  Description of Artificial Sequence: Synthetic peptide
YYYGSGSY

SEQ ID NO: 3973 - protein, 8 aa, Artificial Sequence
  Description of Artificial Sequence: Synthetic peptide
YYGSGSYY

SEQ ID NO: 3974 - protein, 8 aa, Artificial Sequence
  Description of Artificial Sequence: Synthetic peptide
YGSGSYYN

SEQ ID NO: 3975 - protein, 7 aa, Artificial Sequence
  Description of Artificial Sequence: Synthetic peptide
YYYGSGS

SEQ ID NO: 3976 - protein, 7 aa, Artificial Sequence
  Description of Artificial Sequence: Synthetic peptide
YYGSGSY

SEQ ID NO: 3977 - protein, 7 aa, Artificial Sequence
  Description of Artificial Sequence: Synthetic peptide
YGSGSYY

SEQ ID NO: 3978 - protein, 7 aa, Artificial Sequence
  Description of Artificial Sequence: Synthetic peptide
GSGSYYN

SEQ ID NO: 3979 - protein, 6 aa, Artificial Sequence
  Description of Artificial Sequence: Synthetic peptide
YYYGSG

SEQ ID NO: 3980 - protein, 6 aa, Artificial Sequence
  Description of Artificial Sequence: Synthetic peptide
YYGSGS

SEQ ID NO: 3981 - protein, 6 aa, Artificial Sequence
  Description of Artificial Sequence: Synthetic peptide
YGSGSY

SEQ ID NO: 3982 - protein, 6 aa, Artificial Sequence
  Description of Artificial Sequence: Synthetic peptide
GSGSYY

SEQ ID NO: 3983 - protein, 6 aa, Artificial Sequence
  Description of Artificial Sequence: Synthetic peptide
SGSYYN

SEQ ID NO: 3984 - protein, 5 aa, Artificial Sequence
  Description of Artificial Sequence: Synthetic peptide
YYYGS

SEQ ID NO: 3985 - protein, 5 aa, Artificial Sequence
  Description of Artificial Sequence: Synthetic peptide
YYGSG

SEQ ID NO: 3986 - protein, 5 aa, Artificial Sequence
  Description of Artificial Sequence: Synthetic peptide
YGSGS

SEQ ID NO: 3987 - protein, 5 aa, Artificial Sequence
  Description of Artificial Sequence: Synthetic peptide
GSGSY

SEQ ID NO: 3988 - protein, 5 aa, Artificial Sequence
  Description of Artificial Sequence: Synthetic peptide
GSYYN

SEQ ID NO: 3989 - protein, 4 aa, Artificial Sequence
  Description of Artificial Sequence: Synthetic peptide
YYYG

SEQ ID NO: 3990 - protein, 4 aa, Artificial Sequence
  Description of Artificial Sequence: Synthetic peptide
YYGS

SEQ ID NO: 3991 - protein, 4 aa, Artificial Sequence
  Description of Artificial Sequence: Synthetic peptide
YGSG

SEQ ID NO: 3992 - protein, 4 aa, Artificial Sequence
  Description of Artificial Sequence: Synthetic peptide
GSGS

SEQ ID NO: 3993 - protein, 4 aa, Artificial Sequence
  Description of Artificial Sequence: Synthetic peptide
SYYN

SEQ ID NO: 3994 - protein, 10 aa, Artificial Sequence
  Description of Artificial Sequence: Synthetic peptide
ITMVRGVIIT

SEQ ID NO: 3995 - protein, 9 aa, Artificial Sequence
  Description of Artificial Sequence: Synthetic peptide
ITMVRGVII

SEQ ID NO: 3996 - protein, 9 aa, Artificial Sequence
  Description of Artificial Sequence: Synthetic peptide
TMVRGVIIT

SEQ ID NO: 3997 - protein, 8 aa, Artificial Sequence
  Description of Artificial Sequence: Synthetic peptide
ITMVRGVI

SEQ ID NO: 3998 - protein, 8 aa, Artificial Sequence
  Description of Artificial Sequence: Synthetic peptide
TMVRGVII

SEQ ID NO: 3999 - protein, 8 aa, Artificial Sequence
  Description of Artificial Sequence: Synthetic peptide
MVRGVIIT

SEQ ID NO: 4000 - protein, 7 aa, Artificial Sequence
  Description of Artificial Sequence: Synthetic peptide
ITMVRGV

SEQ ID NO: 4001 - protein, 7 aa, Artificial Sequence
  Description of Artificial Sequence: Synthetic peptide
TMVRGVI

SEQ ID NO: 4002 - protein, 7 aa, Artificial Sequence
  Description of Artificial Sequence: Synthetic peptide
MVRGVII

SEQ ID NO: 4003 - protein, 7 aa, Artificial Sequence
  Description of Artificial Sequence: Synthetic peptide
VRGVIIT

SEQ ID NO: 4004 - protein, 6 aa, Artificial Sequence
  Description of Artificial Sequence: Synthetic peptide
ITMVRG

SEQ ID NO: 4005 - protein, 6 aa, Artificial Sequence
  Description of Artificial Sequence: Synthetic peptide
TMVRGV

SEQ ID NO: 4006 - protein, 6 aa, Artificial Sequence
  Description of Artificial Sequence: Synthetic peptide
MVRGVI

SEQ ID NO: 4007 - protein, 6 aa, Artificial Sequence
  Description of Artificial Sequence: Synthetic peptide
VRGVII

SEQ ID NO: 4008 - protein, 6 aa, Artificial Sequence
  Description of Artificial Sequence: Synthetic peptide
RGVIIT

SEQ ID NO: 4009 - protein, 5 aa, Artificial Sequence
  Description of Artificial Sequence: Synthetic peptide
ITMVR

SEQ ID NO: 4010 - protein, 5 aa, Artificial Sequence
  Description of Artificial Sequence: Synthetic peptide
TMVRG

SEQ ID NO: 4011 - protein, 5 aa, Artificial Sequence
  Description of Artificial Sequence: Synthetic peptide
MVRGV

SEQ ID NO: 4012 - protein, 5 aa, Artificial Sequence
  Description of Artificial Sequence: Synthetic peptide
VRGVI

SEQ ID NO: 4013 - protein, 5 aa, Artificial Sequence
  Description of Artificial Sequence: Synthetic peptide
RGVII

SEQ ID NO: 4014 - protein, 5 aa, Artificial Sequence
  Description of Artificial Sequence: Synthetic peptide
GVIIT

SEQ ID NO: 4015 - protein, 4 aa, Artificial Sequence
  Description of Artificial Sequence: Synthetic peptide
ITMV

SEQ ID NO: 4016 - protein, 4 aa, Artificial Sequence
  Description of Artificial Sequence: Synthetic peptide
TMVR

SEQ ID NO: 4017 - protein, 4 aa, Artificial Sequence
  Description of Artificial Sequence: Synthetic peptide
MVRG

SEQ ID NO: 4018 - protein, 4 aa, Artificial Sequence
  Description of Artificial Sequence: Synthetic peptide
VRGV

SEQ ID NO: 4019 - protein, 4 aa, Artificial Sequence
  Description of Artificial Sequence: Synthetic peptide
RGVI

SEQ ID NO: 4020 - protein, 4 aa, Artificial Sequence
  Description of Artificial Sequence: Synthetic peptide
GVII

SEQ ID NO: 4021 - protein, 4 aa, Artificial Sequence
  Description of Artificial Sequence: Synthetic peptide
VIIT

SEQ ID NO: 4022 - protein, 9 aa, Artificial Sequence
  Description of Artificial Sequence: Synthetic peptide
VLLWFRELL

SEQ ID NO: 4023 - protein, 8 aa, Artificial Sequence
  Description of Artificial Sequence: Synthetic peptide
VLLWFREL

SEQ ID NO: 4024 - protein, 8 aa, Artificial Sequence
  Description of Artificial Sequence: Synthetic peptide
LLWFRELL

SEQ ID NO: 4025 - protein, 7 aa, Artificial Sequence
  Description of Artificial Sequence: Synthetic peptide
VLLWFRE

SEQ ID NO: 4026 - protein, 7 aa, Artificial Sequence
  Description of Artificial Sequence: Synthetic peptide
LLWFREL

SEQ ID NO: 4027 - protein, 7 aa, Artificial Sequence
  Description of Artificial Sequence: Synthetic peptide
LWFRELL

SEQ ID NO: 4028 - protein, 6 aa, Artificial Sequence
  Description of Artificial Sequence: Synthetic peptide
VLLWFR

SEQ ID NO: 4029 - protein, 6 aa, Artificial Sequence
  Description of Artificial Sequence: Synthetic peptide
LLWFRE

SEQ ID NO: 4030 - protein, 6 aa, Artificial Sequence
  Description of Artificial Sequence: Synthetic peptide
LWFREL

SEQ ID NO: 4031 - protein, 6 aa, Artificial Sequence
  Description of Artificial Sequence: Synthetic peptide
WFRELL

SEQ ID NO: 4032 - protein, 5 aa, Artificial Sequence
  Description of Artificial Sequence: Synthetic peptide
LLWFR

SEQ ID NO: 4033 - protein, 5 aa, Artificial Sequence
  Description of Artificial Sequence: Synthetic peptide
LWFRE

SEQ ID NO: 4034 - protein, 5 aa, Artificial Sequence
  Description of Artificial Sequence: Synthetic peptide
WFREL

SEQ ID NO: 4035 - protein, 5 aa, Artificial Sequence
  Description of Artificial Sequence: Synthetic peptide
FRELL

SEQ ID NO: 4036 - protein, 4 aa, Artificial Sequence
  Description of Artificial Sequence: Synthetic peptide
LWFR

SEQ ID NO: 4037 - protein, 4 aa, Artificial Sequence
  Description of Artificial Sequence: Synthetic peptide
WFRE

SEQ ID NO: 4038 - protein, 4 aa, Artificial Sequence
  Description of Artificial Sequence: Synthetic peptide
FREL

SEQ ID NO: 4039 - protein, 4 aa, Artificial Sequence
  Description of Artificial Sequence: Synthetic peptide
RELL

SEQ ID NO: 4040 - protein, 10 aa, Artificial Sequence
  Description of Artificial Sequence: Synthetic peptide
ITMVQGVIIT

SEQ ID NO: 4041 - protein, 9 aa, Artificial Sequence
  Description of Artificial Sequence: Synthetic peptide
ITMVQGVII

SEQ ID NO: 4042 - protein, 9 aa, Artificial Sequence
  Description of Artificial Sequence: Synthetic peptide
TMVQGVIIT

SEQ ID NO: 4043 - protein, 8 aa, Artificial Sequence
  Description of Artificial Sequence: Synthetic peptide
ITMVQGVI

SEQ ID NO: 4044 - protein, 8 aa, Artificial Sequence
  Description of Artificial Sequence: Synthetic peptide
TMVQGVII

SEQ ID NO: 4045 - protein, 8 aa, Artificial Sequence
  Description of Artificial Sequence: Synthetic peptide
MVQGVIIT

SEQ ID NO: 4046 - protein, 7 aa, Artificial Sequence
  Description of Artificial Sequence: Synthetic peptide
ITMVQGV

SEQ ID NO: 4047 - protein, 7 aa, Artificial Sequence
  Description of Artificial Sequence: Synthetic peptide
TMVQGVI

SEQ ID NO: 4048 - protein, 7 aa, Artificial Sequence
  Description of Artificial Sequence: Synthetic peptide
MVQGVII

SEQ ID NO: 4049 - protein, 7 aa, Artificial Sequence
  Description of Artificial Sequence: Synthetic peptide
VQGVIIT

SEQ ID NO: 4050 - protein, 6 aa, Artificial Sequence
  Description of Artificial Sequence: Synthetic peptide
ITMVQG

SEQ ID NO: 4051 - protein, 6 aa, Artificial Sequence
  Description of Artificial Sequence: Synthetic peptide
TMVQGV

SEQ ID NO: 4052 - protein, 6 aa, Artificial Sequence
  Description of Artificial Sequence: Synthetic peptide
MVQGVI

SEQ ID NO: 4053 - protein, 6 aa, Artificial Sequence
  Description of Artificial Sequence: Synthetic peptide
VQGVII

SEQ ID NO: 4054 - protein, 6 aa, Artificial Sequence
  Description of Artificial Sequence: Synthetic peptide
QGVIIT

SEQ ID NO: 4055 - protein, 5 aa, Artificial Sequence
  Description of Artificial Sequence: Synthetic peptide
ITMVQ

SEQ ID NO: 4056 - protein, 5 aa, Artificial Sequence
  Description of Artificial Sequence: Synthetic peptide
TMVQG

SEQ ID NO: 4057 - protein, 5 aa, Artificial Sequence
  Description of Artificial Sequence: Synthetic peptide
MVQGV

SEQ ID NO: 4058 - protein, 5 aa, Artificial Sequence
  Description of Artificial Sequence: Synthetic peptide
VQGVI

SEQ ID NO: 4059 - protein, 5 aa, Artificial Sequence
  Description of Artificial Sequence: Synthetic peptide
QGVII

SEQ ID NO: 4060 - protein, 4 aa, Artificial Sequence
  Description of Artificial Sequence: Synthetic peptide
TMVQ

SEQ ID NO: 4061 - protein, 4 aa, Artificial Sequence
  Description of Artificial Sequence: Synthetic peptide
MVQG

SEQ ID NO: 4062 - protein, 4 aa, Artificial Sequence
  Description of Artificial Sequence: Synthetic peptide
VQGV

SEQ ID NO: 4063 - protein, 4 aa, Artificial Sequence
  Description of Artificial Sequence: Synthetic peptide
QGVI

SEQ ID NO: 4064 - protein, 6 aa, Artificial Sequence
  Description of Artificial Sequence: Synthetic peptide
LRLGEL

SEQ ID NO: 4065 - protein, 5 aa, Artificial Sequence
  Description of Artificial Sequence: Synthetic peptide
LRLGE

SEQ ID NO: 4066 - protein, 5 aa, Artificial Sequence
  Description of Artificial Sequence: Synthetic peptide
RLGEL

SEQ ID NO: 4067 - protein, 4 aa, Artificial Sequence
  Description of Artificial Sequence: Synthetic peptide
LRLG

SEQ ID NO: 4068 - protein, 4 aa, Artificial Sequence
  Description of Artificial Sequence: Synthetic peptide
RLGE

SEQ ID NO: 4069 - protein, 4 aa, Artificial Sequence
  Description of Artificial Sequence: Synthetic peptide
LGEL

SEQ ID NO: 4070 - protein, 12 aa, Artificial Sequence
  Description of Artificial Sequence: Synthetic peptide
YYDYVWGSYAYT

SEQ ID NO: 4071 - protein, 11 aa, Artificial Sequence
  Description of Artificial Sequence: Synthetic peptide
YYDYVWGSYAY

SEQ ID NO: 4072 - protein, 11 aa, Artificial Sequence
  Description of Artificial Sequence: Synthetic peptide
YDYVWGSYAYT

SEQ ID NO: 4073 - protein, 10 aa, Artificial Sequence
  Description of Artificial Sequence: Synthetic peptide
YYDYVWGSYA

SEQ ID NO: 4074 - protein, 10 aa, Artificial Sequence
  Description of Artificial Sequence: Synthetic peptide
YDYVWGSYAY

SEQ ID NO: 4075 - protein, 10 aa, Artificial Sequence
  Description of Artificial Sequence: Synthetic peptide
DYVWGSYAYT

SEQ ID NO: 4076 - protein, 9 aa, Artificial Sequence
  Description of Artificial Sequence: Synthetic peptide
YYDYVWGSY

SEQ ID NO: 4077 - protein, 9 aa, Artificial Sequence
  Description of Artificial Sequence: Synthetic peptide
YDYVWGSYA

SEQ ID NO: 4078 - protein, 9 aa, Artificial Sequence
  Description of Artificial Sequence: Synthetic peptide
DYVWGSYAY

SEQ ID NO: 4079 - protein, 9 aa, Artificial Sequence
  Description of Artificial Sequence: Synthetic peptide
YVWGSYAYT

SEQ ID NO: 4080 - protein, 8 aa, Artificial Sequence
  Description of Artificial Sequence: Synthetic peptide
YYDYVWGS

SEQ ID NO: 4081 - protein, 8 aa, Artificial Sequence
  Description of Artificial Sequence: Synthetic peptide
YDYVWGSY

SEQ ID NO: 4082 - protein, 8 aa, Artificial Sequence
  Description of Artificial Sequence: Synthetic peptide
DYVWGSYA

SEQ ID NO: 4083 - protein, 8 aa, Artificial Sequence
  Description of Artificial Sequence: Synthetic peptide
YVWGSYAY

SEQ ID NO: 4084 - protein, 8 aa, Artificial Sequence
  Description of Artificial Sequence: Synthetic peptide
VWGSYAYT

SEQ ID NO: 4085 - protein, 7 aa, Artificial Sequence
  Description of Artificial Sequence: Synthetic peptide
YYDYVWG

SEQ ID NO: 4086 - protein, 7 aa, Artificial Sequence
  Description of Artificial Sequence: Synthetic peptide
YDYVWGS

SEQ ID NO: 4087 - protein, 7 aa, Artificial Sequence
  Description of Artificial Sequence: Synthetic peptide
DYVWGSY

SEQ ID NO: 4088 - protein, 7 aa, Artificial Sequence
  Description of Artificial Sequence: Synthetic peptide
YVWGSYA

SEQ ID NO: 4089 - protein, 7 aa, Artificial Sequence
  Description of Artificial Sequence: Synthetic peptide
VWGSYAY

SEQ ID NO: 4090 - protein, 7 aa, Artificial Sequence
  Description of Artificial Sequence: Synthetic peptide
WGSYAYT

SEQ ID NO: 4091 - protein, 6 aa, Artificial Sequence
  Description of Artificial Sequence: Synthetic peptide
YYDYVW

SEQ ID NO: 4092 - protein, 6 aa, Artificial Sequence
  Description of Artificial Sequence: Synthetic peptide
YDYVWG

SEQ ID NO: 4093 - protein, 6 aa, Artificial Sequence
  Description of Artificial Sequence: Synthetic peptide
DYVWGS

SEQ ID NO: 4094 - protein, 6 aa, Artificial Sequence
  Description of Artificial Sequence: Synthetic peptide
YVWGSY

SEQ ID NO: 4095 - protein, 6 aa, Artificial Sequence
  Description of Artificial Sequence: Synthetic peptide
VWGSYA

SEQ ID NO: 4096 - protein, 6 aa, Artificial Sequence
  Description of Artificial Sequence: Synthetic peptide
WGSYAY

SEQ ID NO: 4097 - protein, 6 aa, Artificial Sequence
  Description of Artificial Sequence: Synthetic peptide
GSYAYT

SEQ ID NO: 4098 - protein, 5 aa, Artificial Sequence
  Description of Artificial Sequence: Synthetic peptide
YYDYV

SEQ ID NO: 4099 - protein, 5 aa, Artificial Sequence
  Description of Artificial Sequence: Synthetic peptide
YDYVW

SEQ ID NO: 4100 - protein, 5 aa, Artificial Sequence
  Description of Artificial Sequence: Synthetic peptide
DYVWG

SEQ ID NO: 4101 - protein, 5 aa, Artificial Sequence
  Description of Artificial Sequence: Synthetic peptide
YVWGS

SEQ ID NO: 4102 - protein, 5 aa, Artificial Sequence
  Description of Artificial Sequence: Synthetic peptide
VWGSY

SEQ ID NO: 4103 - protein, 5 aa, Artificial Sequence
  Description of Artificial Sequence: Synthetic peptide
WGSYA

SEQ ID NO: 4104 - protein, 5 aa, Artificial Sequence
  Description of Artificial Sequence: Synthetic peptide
GSYAY

SEQ ID NO: 4105 - protein, 5 aa, Artificial Sequence
  Description of Artificial Sequence: Synthetic peptide
SYAYT

SEQ ID NO: 4106 - protein, 4 aa, Artificial Sequence
  Description of Artificial Sequence: Synthetic peptide
YYDY

SEQ ID NO: 4107 - protein, 4 aa, Artificial Sequence
  Description of Artificial Sequence: Synthetic peptide
YDYV

SEQ ID NO: 4108 - protein, 4 aa, Artificial Sequence
  Description of Artificial Sequence: Synthetic peptide
DYVW

SEQ ID NO: 4109 - protein, 4 aa, Artificial Sequence
  Description of Artificial Sequence: Synthetic peptide
YVWG

SEQ ID NO: 4110 - protein, 4 aa, Artificial Sequence
  Description of Artificial Sequence: Synthetic peptide
VWGS

SEQ ID NO: 4111 - protein, 4 aa, Artificial Sequence
  Description of Artificial Sequence: Synthetic peptide
WGSY

SEQ ID NO: 4112 - protein, 4 aa, Artificial Sequence
  Description of Artificial Sequence: Synthetic peptide
GSYA

SEQ ID NO: 4113 - protein, 4 aa, Artificial Sequence
  Description of Artificial Sequence: Synthetic peptide
SYAY

SEQ ID NO: 4114 - protein, 4 aa, Artificial Sequence
  Description of Artificial Sequence: Synthetic peptide
YAYT

SEQ ID NO: 4115 - protein, 12 aa, Artificial Sequence
  Description of Artificial Sequence: Synthetic peptide
IMITFGGVMLIP

SEQ ID NO: 4116 - protein, 11 aa, Artificial Sequence
  Description of Artificial Sequence: Synthetic peptide
IMITFGGVMLI

SEQ ID NO: 4117 - protein, 11 aa, Artificial Sequence
  Description of Artificial Sequence: Synthetic peptide
MITFGGVMLIP

SEQ ID NO: 4118 - protein, 10 aa, Artificial Sequence
  Description of Artificial Sequence: Synthetic peptide
IMITFGGVML

SEQ ID NO: 4119 - protein, 10 aa, Artificial Sequence
  Description of Artificial Sequence: Synthetic peptide
MITFGGVMLI

SEQ ID NO: 4120 - protein, 10 aa, Artificial Sequence
  Description of Artificial Sequence: Synthetic peptide
ITFGGVMLIP

SEQ ID NO: 4121 - protein, 9 aa, Artificial Sequence
  Description of Artificial Sequence: Synthetic peptide
IMITFGGVM

SEQ ID NO: 4122 - protein, 9 aa, Artificial Sequence
  Description of Artificial Sequence: Synthetic peptide
MITFGGVML

SEQ ID NO: 4123 - protein, 9 aa, Artificial Sequence
  Description of Artificial Sequence: Synthetic peptide
ITFGGVMLI

SEQ ID NO: 4124 - protein, 9 aa, Artificial Sequence
  Description of Artificial Sequence: Synthetic peptide
TFGGVMLIP

SEQ ID NO: 4125 - protein, 8 aa, Artificial Sequence
  Description of Artificial Sequence: Synthetic peptide
IMITFGGV

SEQ ID NO: 4126 - protein, 8 aa, Artificial Sequence
  Description of Artificial Sequence: Synthetic peptide
MITFGGVM

SEQ ID NO: 4127 - protein, 8 aa, Artificial Sequence
  Description of Artificial Sequence: Synthetic peptide
ITFGGVML

SEQ ID NO: 4128 - protein, 8 aa, Artificial Sequence
  Description of Artificial Sequence: Synthetic peptide
TFGGVMLI

SEQ ID NO: 4129 - protein, 8 aa, Artificial Sequence
  Description of Artificial Sequence: Synthetic peptide
FGGVMLIP

SEQ ID NO: 4130 - protein, 7 aa, Artificial Sequence
  Description of Artificial Sequence: Synthetic peptide
IMITFGG

SEQ ID NO: 4131 - protein, 7 aa, Artificial Sequence
  Description of Artificial Sequence: Synthetic peptide
MITFGGV

SEQ ID NO: 4132 - protein, 7 aa, Artificial Sequence
  Description of Artificial Sequence: Synthetic peptide
ITFGGVM

SEQ ID NO: 4133 - protein, 7 aa, Artificial Sequence
  Description of Artificial Sequence: Synthetic peptide
TFGGVML

SEQ ID NO: 4134 - protein, 7 aa, Artificial Sequence
  Description of Artificial Sequence: Synthetic peptide
FGGVMLI

SEQ ID NO: 4135 - protein, 7 aa, Artificial Sequence
  Description of Artificial Sequence: Synthetic peptide
GGVMLIP

SEQ ID NO: 4136 - protein, 6 aa, Artificial Sequence
  Description of Artificial Sequence: Synthetic peptide
IMITFG

SEQ ID NO: 4137 - protein, 6 aa, Artificial Sequence
  Description of Artificial Sequence: Synthetic peptide
MITFGG

SEQ ID NO: 4138 - protein, 6 aa, Artificial Sequence
  Description of Artificial Sequence: Synthetic peptide
ITFGGV

SEQ ID NO: 4139 - protein, 6 aa, Artificial Sequence
  Description of Artificial Sequence: Synthetic peptide
TFGGVM

SEQ ID NO: 4140 - protein, 6 aa, Artificial Sequence
  Description of Artificial Sequence: Synthetic peptide
FGGVML

SEQ ID NO: 4141 - protein, 6 aa, Artificial Sequence
  Description of Artificial Sequence: Synthetic peptide
GGVMLI

SEQ ID NO: 4142 - protein, 6 aa, Artificial Sequence
  Description of Artificial Sequence: Synthetic peptide
GVMLIP

SEQ ID NO: 4143 - protein, 5 aa, Artificial Sequence
  Description of Artificial Sequence: Synthetic peptide
IMITF

SEQ ID NO: 4144 - protein, 5 aa, Artificial Sequence
  Description of Artificial Sequence: Synthetic peptide
MITFG

SEQ ID NO: 4145 - protein, 5 aa, Artificial Sequence
  Description of Artificial Sequence: Synthetic peptide
ITFGG

SEQ ID NO: 4146 - protein, 5 aa, Artificial Sequence
  Description of Artificial Sequence: Synthetic peptide
TFGGV

SEQ ID NO: 4147 - protein, 5 aa, Artificial Sequence
  Description of Artificial Sequence: Synthetic peptide
FGGVM

SEQ ID NO: 4148 - protein, 5 aa, Artificial Sequence
  Description of Artificial Sequence: Synthetic peptide
GGVML

SEQ ID NO: 4149 - protein, 5 aa, Artificial Sequence
  Description of Artificial Sequence: Synthetic peptide
GVMLI

SEQ ID NO: 4150 - protein, 5 aa, Artificial Sequence
  Description of Artificial Sequence: Synthetic peptide
VMLIP

SEQ ID NO: 4151 - protein, 4 aa, Artificial Sequence
  Description of Artificial Sequence: Synthetic peptide
IMIT

SEQ ID NO: 4152 - protein, 4 aa, Artificial Sequence
  Description of Artificial Sequence: Synthetic peptide
MITF

SEQ ID NO: 4153 - protein, 4 aa, Artificial Sequence
  Description of Artificial Sequence: Synthetic peptide
ITFG

SEQ ID NO: 4154 - protein, 4 aa, Artificial Sequence
  Description of Artificial Sequence: Synthetic peptide
TFGG

SEQ ID NO: 4155 - protein, 4 aa, Artificial Sequence
  Description of Artificial Sequence: Synthetic peptide
FGGV

SEQ ID NO: 4156 - protein, 4 aa, Artificial Sequence
  Description of Artificial Sequence: Synthetic peptide
GGVM

SEQ ID NO: 4157 - protein, 4 aa, Artificial Sequence
  Description of Artificial Sequence: Synthetic peptide
GVML

SEQ ID NO: 4158 - protein, 4 aa, Artificial Sequence
  Description of Artificial Sequence: Synthetic peptide
VMLI

SEQ ID NO: 4159 - protein, 4 aa, Artificial Sequence
  Description of Artificial Sequence: Synthetic peptide
MLIP

SEQ ID NO: 4160 - protein, 4 aa, Artificial Sequence
  Description of Artificial Sequence: Synthetic peptide
WLLL

SEQ ID NO: 4161 - protein, 10 aa, Artificial Sequence
  Description of Artificial Sequence: Synthetic peptide
YYYDSSGYYY

SEQ ID NO: 4162 - protein, 9 aa, Artificial Sequence
  Description of Artificial Sequence: Synthetic peptide
YYYDSSGYY

SEQ ID NO: 4163 - protein, 9 aa, Artificial Sequence
  Description of Artificial Sequence: Synthetic peptide
YYDSSGYYY

SEQ ID NO: 4164 - protein, 8 aa, Artificial Sequence
  Description of Artificial Sequence: Synthetic peptide
YYYDSSGY

SEQ ID NO: 4165 - protein, 8 aa, Artificial Sequence
  Description of Artificial Sequence: Synthetic peptide
YYDSSGYY

SEQ ID NO: 4166 - protein, 8 aa, Artificial Sequence
  Description of Artificial Sequence: Synthetic peptide
YDSSGYYY

SEQ ID NO: 4167 - protein, 7 aa, Artificial Sequence
  Description of Artificial Sequence: Synthetic peptide
YYYDSSG

SEQ ID NO: 4168 - protein, 7 aa, Artificial Sequence
  Description of Artificial Sequence: Synthetic peptide
YYDSSGY

SEQ ID NO: 4169 - protein, 7 aa, Artificial Sequence
  Description of Artificial Sequence: Synthetic peptide
YDSSGYY

SEQ ID NO: 4170 - protein, 7 aa, Artificial Sequence
  Description of Artificial Sequence: Synthetic peptide
DSSGYYY

SEQ ID NO: 4171 - protein, 6 aa, Artificial Sequence
  Description of Artificial Sequence: Synthetic peptide
YYYDSS

SEQ ID NO: 4172 - protein, 6 aa, Artificial Sequence
  Description of Artificial Sequence: Synthetic peptide
YYDSSG

SEQ ID NO: 4173 - protein, 6 aa, Artificial Sequence
  Description of Artificial Sequence: Synthetic peptide
YDSSGY

SEQ ID NO: 4174 - protein, 6 aa, Artificial Sequence
  Description of Artificial Sequence: Synthetic peptide
DSSGYY

SEQ ID NO: 4175 - protein, 6 aa, Artificial Sequence
  Description of Artificial Sequence: Synthetic peptide
SSGYYY

SEQ ID NO: 4176 - protein, 5 aa, Artificial Sequence
  Description of Artificial Sequence: Synthetic peptide
YYYDS

SEQ ID NO: 4177 - protein, 5 aa, Artificial Sequence
  Description of Artificial Sequence: Synthetic peptide
YYDSS

SEQ ID NO: 4178 - protein, 5 aa, Artificial Sequence
  Description of Artificial Sequence: Synthetic peptide
YDSSG

SEQ ID NO: 4179 - protein, 5 aa, Artificial Sequence
  Description of Artificial Sequence: Synthetic peptide
DSSGY

SEQ ID NO: 4180 - protein, 5 aa, Artificial Sequence
  Description of Artificial Sequence: Synthetic peptide
SSGYY

SEQ ID NO: 4181 - protein, 5 aa, Artificial Sequence
  Description of Artificial Sequence: Synthetic peptide
SGYYY

SEQ ID NO: 4182 - protein, 4 aa, Artificial Sequence
  Description of Artificial Sequence: Synthetic peptide
YYYD

SEQ ID NO: 4183 - protein, 4 aa, Artificial Sequence
  Description of Artificial Sequence: Synthetic peptide
YYDS

SEQ ID NO: 4184 - protein, 4 aa, Artificial Sequence
  Description of Artificial Sequence: Synthetic peptide
YDSS

SEQ ID NO: 4185 - protein, 4 aa, Artificial Sequence
  Description of Artificial Sequence: Synthetic peptide
DSSG

SEQ ID NO: 4186 - protein, 4 aa, Artificial Sequence
  Description of Artificial Sequence: Synthetic peptide
SSGY

SEQ ID NO: 4187 - protein, 4 aa, Artificial Sequence
  Description of Artificial Sequence: Synthetic peptide
SGYY

SEQ ID NO: 4188 - protein, 4 aa, Artificial Sequence
  Description of Artificial Sequence: Synthetic peptide
GYYY

SEQ ID NO: 4189 - protein, 10 aa, Artificial Sequence
  Description of Artificial Sequence: Synthetic peptide
ITMIVVVITT

SEQ ID NO: 4190 - protein, 9 aa, Artificial Sequence
  Description of Artificial Sequence: Synthetic peptide
ITMIVVVIT

SEQ ID NO: 4191 - protein, 9 aa, Artificial Sequence
  Description of Artificial Sequence: Synthetic peptide
TMIVVVITT

SEQ ID NO: 4192 - protein, 8 aa, Artificial Sequence
  Description of Artificial Sequence: Synthetic peptide
ITMIVVVI

SEQ ID NO: 4193 - protein, 8 aa, Artificial Sequence
  Description of Artificial Sequence: Synthetic peptide
TMIVVVIT

SEQ ID NO: 4194 - protein, 8 aa, Artificial Sequence
  Description of Artificial Sequence: Synthetic peptide
MIVVVITT

SEQ ID NO: 4195 - protein, 7 aa, Artificial Sequence
  Description of Artificial Sequence: Synthetic peptide
ITMIVVV

SEQ ID NO: 4196 - protein, 7 aa, Artificial Sequence
  Description of Artificial Sequence: Synthetic peptide
TMIVVVI

SEQ ID NO: 4197 - protein, 7 aa, Artificial Sequence
  Description of Artificial Sequence: Synthetic peptide
MIVVVIT

SEQ ID NO: 4198 - protein, 7 aa, Artificial Sequence
  Description of Artificial Sequence: Synthetic peptide
IVVVITT

SEQ ID NO: 4199 - protein, 6 aa, Artificial Sequence
  Description of Artificial Sequence: Synthetic peptide
ITMIVV

SEQ ID NO: 4200 - protein, 6 aa, Artificial Sequence
  Description of Artificial Sequence: Synthetic peptide
TMIVVV

SEQ ID NO: 4201 - protein, 6 aa, Artificial Sequence
  Description of Artificial Sequence: Synthetic peptide
MIVVVI

SEQ ID NO: 4202 - protein, 6 aa, Artificial Sequence
  Description of Artificial Sequence: Synthetic peptide
IVVVIT

SEQ ID NO: 4203 - protein, 6 aa, Artificial Sequence
  Description of Artificial Sequence: Synthetic peptide
VVVITT

SEQ ID NO: 4204 - protein, 5 aa, Artificial Sequence
  Description of Artificial Sequence: Synthetic peptide
ITMIV

SEQ ID NO: 4205 - protein, 5 aa, Artificial Sequence
  Description of Artificial Sequence: Synthetic peptide
TMIVV

SEQ ID NO: 4206 - protein, 5 aa, Artificial Sequence
  Description of Artificial Sequence: Synthetic peptide
MIVVV

SEQ ID NO: 4207 - protein, 5 aa, Artificial Sequence
  Description of Artificial Sequence: Synthetic peptide
VVVIT

SEQ ID NO: 4208 - protein, 5 aa, Artificial Sequence
  Description of Artificial Sequence: Synthetic peptide
VVITT

SEQ ID NO: 4209 - protein, 4 aa, Artificial Sequence
  Description of Artificial Sequence: Synthetic peptide
ITMI

SEQ ID NO: 4210 - protein, 4 aa, Artificial Sequence
  Description of Artificial Sequence: Synthetic peptide
TMIV

SEQ ID NO: 4211 - protein, 4 aa, Artificial Sequence
  Description of Artificial Sequence: Synthetic peptide
MIVV

SEQ ID NO: 4212 - protein, 4 aa, Artificial Sequence
  Description of Artificial Sequence: Synthetic peptide
VVIT

SEQ ID NO: 4213 - protein, 4 aa, Artificial Sequence
  Description of Artificial Sequence: Synthetic peptide
VITT

SEQ ID NO: 4214 - protein, 10 aa, Artificial Sequence
  Description of Artificial Sequence: Synthetic peptide
VLRFLEWLLY

SEQ ID NO: 4215 - protein, 9 aa, Artificial Sequence
  Description of Artificial Sequence: Synthetic peptide
VLRFLEWLL

SEQ ID NO: 4216 - protein, 9 aa, Artificial Sequence
  Description of Artificial Sequence: Synthetic peptide
LRFLEWLLY

SEQ ID NO: 4217 - protein, 8 aa, Artificial Sequence
  Description of Artificial Sequence: Synthetic peptide
VLRFLEWL

SEQ ID NO: 4218 - protein, 8 aa, Artificial Sequence
  Description of Artificial Sequence: Synthetic peptide
LRFLEWLL

SEQ ID NO: 4219 - protein, 8 aa, Artificial Sequence
  Description of Artificial Sequence: Synthetic peptide
RFLEWLLY

SEQ ID NO: 4220 - protein, 7 aa, Artificial Sequence
  Description of Artificial Sequence: Synthetic peptide
VLRFLEW

SEQ ID NO: 4221 - protein, 7 aa, Artificial Sequence
  Description of Artificial Sequence: Synthetic peptide
LRFLEWL

SEQ ID NO: 4222 - protein, 7 aa, Artificial Sequence
  Description of Artificial Sequence: Synthetic peptide
RFLEWLL

SEQ ID NO: 4223 - protein, 7 aa, Artificial Sequence
  Description of Artificial Sequence: Synthetic peptide
FLEWLLY

SEQ ID NO: 4224 - protein, 6 aa, Artificial Sequence
  Description of Artificial Sequence: Synthetic peptide
VLRFLE

SEQ ID NO: 4225 - protein, 6 aa, Artificial Sequence
  Description of Artificial Sequence: Synthetic peptide
LRFLEW

SEQ ID NO: 4226 - protein, 6 aa, Artificial Sequence
  Description of Artificial Sequence: Synthetic peptide
RFLEWL

SEQ ID NO: 4227 - protein, 6 aa, Artificial Sequence
  Description of Artificial Sequence: Synthetic peptide
FLEWLL

SEQ ID NO: 4228 - protein, 6 aa, Artificial Sequence
  Description of Artificial Sequence: Synthetic peptide
LEWLLY

SEQ ID NO: 4229 - protein, 5 aa, Artificial Sequence
  Description of Artificial Sequence: Synthetic peptide
VLRFL

SEQ ID NO: 4230 - protein, 5 aa, Artificial Sequence
  Description of Artificial Sequence: Synthetic peptide
LRFLE

SEQ ID NO: 4231 - protein, 5 aa, Artificial Sequence
  Description of Artificial Sequence: Synthetic peptide
RFLEW

SEQ ID NO: 4232 - protein, 5 aa, Artificial Sequence
  Description of Artificial Sequence: Synthetic peptide
FLEWL

SEQ ID NO: 4233 - protein, 5 aa, Artificial Sequence
  Description of Artificial Sequence: Synthetic peptide
LEWLL

SEQ ID NO: 4234 - protein, 5 aa, Artificial Sequence
  Description of Artificial Sequence: Synthetic peptide
EWLLY

SEQ ID NO: 4235 - protein, 4 aa, Artificial Sequence
  Description of Artificial Sequence: Synthetic peptide
VLRF

SEQ ID NO: 4236 - protein, 4 aa, Artificial Sequence
  Description of Artificial Sequence: Synthetic peptide
LRFL

SEQ ID NO: 4237 - protein, 4 aa, Artificial Sequence
  Description of Artificial Sequence: Synthetic peptide
RFLE

SEQ ID NO: 4238 - protein, 4 aa, Artificial Sequence
  Description of Artificial Sequence: Synthetic peptide
FLEW

SEQ ID NO: 4239 - protein, 4 aa, Artificial Sequence
  Description of Artificial Sequence: Synthetic peptide
LEWL

SEQ ID NO: 4240 - protein, 4 aa, Artificial Sequence
  Description of Artificial Sequence: Synthetic peptide
EWLL

SEQ ID NO: 4241 - protein, 4 aa, Artificial Sequence
  Description of Artificial Sequence: Synthetic peptide
WLLY

SEQ ID NO: 4242 - protein, 10 aa, Artificial Sequence
  Description of Artificial Sequence: Synthetic peptide
YYDFWSGYYT

SEQ ID NO: 4243 - protein, 9 aa, Artificial Sequence
  Description of Artificial Sequence: Synthetic peptide
YYDFWSGYY

SEQ ID NO: 4244 - protein, 9 aa, Artificial Sequence
  Description of Artificial Sequence: Synthetic peptide
YDFWSGYYT

SEQ ID NO: 4245 - protein, 8 aa, Artificial Sequence
  Description of Artificial Sequence: Synthetic peptide
YYDFWSGY

SEQ ID NO: 4246 - protein, 8 aa, Artificial Sequence
  Description of Artificial Sequence: Synthetic peptide
YDFWSGYY

SEQ ID NO: 4247 - protein, 8 aa, Artificial Sequence
  Description of Artificial Sequence: Synthetic peptide
DFWSGYYT

SEQ ID NO: 4248 - protein, 7 aa, Artificial Sequence
  Description of Artificial Sequence: Synthetic peptide
YYDFWSG

SEQ ID NO: 4249 - protein, 7 aa, Artificial Sequence
  Description of Artificial Sequence: Synthetic peptide
YDFWSGY

SEQ ID NO: 4250 - protein, 7 aa, Artificial Sequence
  Description of Artificial Sequence: Synthetic peptide
DFWSGYY

SEQ ID NO: 4251 - protein, 7 aa, Artificial Sequence
  Description of Artificial Sequence: Synthetic peptide
FWSGYYT

SEQ ID NO: 4252 - protein, 6 aa, Artificial Sequence
  Description of Artificial Sequence: Synthetic peptide
YYDFWS

SEQ ID NO: 4253 - protein, 6 aa, Artificial Sequence
  Description of Artificial Sequence: Synthetic peptide
YDFWSG

SEQ ID NO: 4254 - protein, 6 aa, Artificial Sequence
  Description of Artificial Sequence: Synthetic peptide
DFWSGY

SEQ ID NO: 4255 - protein, 6 aa, Artificial Sequence
  Description of Artificial Sequence: Synthetic peptide
FWSGYY

SEQ ID NO: 4256 - protein, 6 aa, Artificial Sequence
  Description of Artificial Sequence: Synthetic peptide
WSGYYT

SEQ ID NO: 4257 - protein, 5 aa, Artificial Sequence
  Description of Artificial Sequence: Synthetic peptide
YYDFW

SEQ ID NO: 4258 - protein, 5 aa, Artificial Sequence
  Description of Artificial Sequence: Synthetic peptide
YDFWS

SEQ ID NO: 4259 - protein, 5 aa, Artificial Sequence
  Description of Artificial Sequence: Synthetic peptide
DFWSG

SEQ ID NO: 4260 - protein, 5 aa, Artificial Sequence
  Description of Artificial Sequence: Synthetic peptide
FWSGY

SEQ ID NO: 4261 - protein, 5 aa, Artificial Sequence
  Description of Artificial Sequence: Synthetic peptide
WSGYY

SEQ ID NO: 4262 - protein, 5 aa, Artificial Sequence
  Description of Artificial Sequence: Synthetic peptide
SGYYT

SEQ ID NO: 4263 - protein, 4 aa, Artificial Sequence
  Description of Artificial Sequence: Synthetic peptide
YYDF

SEQ ID NO: 4264 - protein, 4 aa, Artificial Sequence
  Description of Artificial Sequence: Synthetic peptide
YDFW

SEQ ID NO: 4265 - protein, 4 aa, Artificial Sequence
  Description of Artificial Sequence: Synthetic peptide
DFWS

SEQ ID NO: 4266 - protein, 4 aa, Artificial Sequence
  Description of Artificial Sequence: Synthetic peptide
FWSG

SEQ ID NO: 4267 - protein, 4 aa, Artificial Sequence
  Description of Artificial Sequence: Synthetic peptide
WSGY

SEQ ID NO: 4268 - protein, 4 aa, Artificial Sequence
  Description of Artificial Sequence: Synthetic peptide
GYYT

SEQ ID NO: 4269 - protein, 10 aa, Artificial Sequence
  Description of Artificial Sequence: Synthetic peptide
ITIFGVVIIP

SEQ ID NO: 4270 - protein, 9 aa, Artificial Sequence
  Description of Artificial Sequence: Synthetic peptide
ITIFGVVII

SEQ ID NO: 4271 - protein, 9 aa, Artificial Sequence
  Description of Artificial Sequence: Synthetic peptide
TIFGVVIIP

SEQ ID NO: 4272 - protein, 8 aa, Artificial Sequence
  Description of Artificial Sequence: Synthetic peptide
ITIFGVVI

SEQ ID NO: 4273 - protein, 8 aa, Artificial Sequence
  Description of Artificial Sequence: Synthetic peptide
TIFGVVII

SEQ ID NO: 4274 - protein, 8 aa, Artificial Sequence
  Description of Artificial Sequence: Synthetic peptide
IFGVVIIP

SEQ ID NO: 4275 - protein, 7 aa, Artificial Sequence
  Description of Artificial Sequence: Synthetic peptide
ITIFGVV

SEQ ID NO: 4276 - protein, 7 aa, Artificial Sequence
  Description of Artificial Sequence: Synthetic peptide
TIFGVVI

SEQ ID NO: 4277 - protein, 7 aa, Artificial Sequence
  Description of Artificial Sequence: Synthetic peptide
IFGVVII

SEQ ID NO: 4278 - protein, 7 aa, Artificial Sequence
  Description of Artificial Sequence: Synthetic peptide
FGVVIIP

SEQ ID NO: 4279 - protein, 6 aa, Artificial Sequence
  Description of Artificial Sequence: Synthetic peptide
ITIFGV

SEQ ID NO: 4280 - protein, 6 aa, Artificial Sequence
  Description of Artificial Sequence: Synthetic peptide
TIFGVV

SEQ ID NO: 4281 - protein, 6 aa, Artificial Sequence
  Description of Artificial Sequence: Synthetic peptide
IFGVVI

SEQ ID NO: 4282 - protein, 6 aa, Artificial Sequence
  Description of Artificial Sequence: Synthetic peptide
FGVVII

SEQ ID NO: 4283 - protein, 6 aa, Artificial Sequence
  Description of Artificial Sequence: Synthetic peptide
GVVIIP

SEQ ID NO: 4284 - protein, 5 aa, Artificial Sequence
  Description of Artificial Sequence: Synthetic peptide
ITIFG

SEQ ID NO: 4285 - protein, 5 aa, Artificial Sequence
  Description of Artificial Sequence: Synthetic peptide
TIFGV

SEQ ID NO: 4286 - protein, 5 aa, Artificial Sequence
  Description of Artificial Sequence: Synthetic peptide
IFGVV

SEQ ID NO: 4287 - protein, 5 aa, Artificial Sequence
  Description of Artificial Sequence: Synthetic peptide
FGVVI

SEQ ID NO: 4288 - protein, 5 aa, Artificial Sequence
  Description of Artificial Sequence: Synthetic peptide
GVVII

SEQ ID NO: 4289 - protein, 5 aa, Artificial Sequence
  Description of Artificial Sequence: Synthetic peptide
VVIIP

SEQ ID NO: 4290 - protein, 4 aa, Artificial Sequence
  Description of Artificial Sequence: Synthetic peptide
ITIF

SEQ ID NO: 4291 - protein, 4 aa, Artificial Sequence
  Description of Artificial Sequence: Synthetic peptide
TIFG

SEQ ID NO: 4292 - protein, 4 aa, Artificial Sequence
  Description of Artificial Sequence: Synthetic peptide
IFGV

SEQ ID NO: 4293 - protein, 4 aa, Artificial Sequence
  Description of Artificial Sequence: Synthetic peptide
FGVV

SEQ ID NO: 4294 - protein, 4 aa, Artificial Sequence
  Description of Artificial Sequence: Synthetic peptide
GVVI

SEQ ID NO: 4295 - protein, 4 aa, Artificial Sequence
  Description of Artificial Sequence: Synthetic peptide
VVII

SEQ ID NO: 4296 - protein, 4 aa, Artificial Sequence
  Description of Artificial Sequence: Synthetic peptide
VIIP

SEQ ID NO: 4297 - protein, 9 aa, Artificial Sequence
  Description of Artificial Sequence: Synthetic peptide
VLRYFDWLL

SEQ ID NO: 4298 - protein, 8 aa, Artificial Sequence
  Description of Artificial Sequence: Synthetic peptide
VLRYFDWL

SEQ ID NO: 4299 - protein, 8 aa, Artificial Sequence
  Description of Artificial Sequence: Synthetic peptide
LRYFDWLL

SEQ ID NO: 4300 - protein, 7 aa, Artificial Sequence
  Description of Artificial Sequence: Synthetic peptide
VLRYFDW

SEQ ID NO: 4301 - protein, 7 aa, Artificial Sequence
  Description of Artificial Sequence: Synthetic peptide
LRYFDWL

SEQ ID NO: 4302 - protein, 7 aa, Artificial Sequence
  Description of Artificial Sequence: Synthetic peptide
RYFDWLL

SEQ ID NO: 4303 - protein, 6 aa, Artificial Sequence
  Description of Artificial Sequence: Synthetic peptide
VLRYFD

SEQ ID NO: 4304 - protein, 6 aa, Artificial Sequence
  Description of Artificial Sequence: Synthetic peptide
LRYFDW

SEQ ID NO: 4305 - protein, 6 aa, Artificial Sequence
  Description of Artificial Sequence: Synthetic peptide
RYFDWL

SEQ ID NO: 4306 - protein, 6 aa, Artificial Sequence
  Description of Artificial Sequence: Synthetic peptide
YFDWLL

SEQ ID NO: 4307 - protein, 5 aa, Artificial Sequence
  Description of Artificial Sequence: Synthetic peptide
VLRYF

SEQ ID NO: 4308 - protein, 5 aa, Artificial Sequence
  Description of Artificial Sequence: Synthetic peptide
LRYFD

SEQ ID NO: 4309 - protein, 5 aa, Artificial Sequence
  Description of Artificial Sequence: Synthetic peptide
RYFDW

SEQ ID NO: 4310 - protein, 5 aa, Artificial Sequence
  Description of Artificial Sequence: Synthetic peptide
YFDWL

SEQ ID NO: 4311 - protein, 5 aa, Artificial Sequence
  Description of Artificial Sequence: Synthetic peptide
FDWLL

SEQ ID NO: 4312 - protein, 4 aa, Artificial Sequence
  Description of Artificial Sequence: Synthetic peptide
VLRY

SEQ ID NO: 4313 - protein, 4 aa, Artificial Sequence
  Description of Artificial Sequence: Synthetic peptide
LRYF

SEQ ID NO: 4314 - protein, 4 aa, Artificial Sequence
  Description of Artificial Sequence: Synthetic peptide
RYFD

SEQ ID NO: 4315 - protein, 4 aa, Artificial Sequence
  Description of Artificial Sequence: Synthetic peptide
YFDW

SEQ ID NO: 4316 - protein, 4 aa, Artificial Sequence
  Description of Artificial Sequence: Synthetic peptide
FDWL

SEQ ID NO: 4317 - protein, 4 aa, Artificial Sequence
  Description of Artificial Sequence: Synthetic peptide
DWLL

SEQ ID NO: 4318 - protein, 10 aa, Artificial Sequence
  Description of Artificial Sequence: Synthetic peptide
YYDILTGYYN

SEQ ID NO: 4319 - protein, 9 aa, Artificial Sequence
  Description of Artificial Sequence: Synthetic peptide
YYDILTGYY

SEQ ID NO: 4320 - protein, 9 aa, Artificial Sequence
  Description of Artificial Sequence: Synthetic peptide
YDILTGYYN

SEQ ID NO: 4321 - protein, 8 aa, Artificial Sequence
  Description of Artificial Sequence: Synthetic peptide
YYDILTGY

SEQ ID NO: 4322 - protein, 8 aa, Artificial Sequence
  Description of Artificial Sequence: Synthetic peptide
YDILTGYY

SEQ ID NO: 4323 - protein, 8 aa, Artificial Sequence
  Description of Artificial Sequence: Synthetic peptide
DILTGYYN

SEQ ID NO: 4324 - protein, 7 aa, Artificial Sequence
  Description of Artificial Sequence: Synthetic peptide
YYDILTG

SEQ ID NO: 4325 - protein, 7 aa, Artificial Sequence
  Description of Artificial Sequence: Synthetic peptide
YDILTGY

SEQ ID NO: 4326 - protein, 7 aa, Artificial Sequence
  Description of Artificial Sequence: Synthetic peptide
DILTGYY

SEQ ID NO: 4327 - protein, 7 aa, Artificial Sequence
  Description of Artificial Sequence: Synthetic peptide
ILTGYYN

SEQ ID NO: 4328 - protein, 6 aa, Artificial Sequence
  Description of Artificial Sequence: Synthetic peptide
YYDILT

SEQ ID NO: 4329 - protein, 6 aa, Artificial Sequence
  Description of Artificial Sequence: Synthetic peptide
YDILTG

SEQ ID NO: 4330 - protein, 6 aa, Artificial Sequence
  Description of Artificial Sequence: Synthetic peptide
DILTGY

SEQ ID NO: 4331 - protein, 6 aa, Artificial Sequence
  Description of Artificial Sequence: Synthetic peptide
ILTGYY

SEQ ID NO: 4332 - protein, 6 aa, Artificial Sequence
  Description of Artificial Sequence: Synthetic peptide
LTGYYN

SEQ ID NO: 4333 - protein, 5 aa, Artificial Sequence
  Description of Artificial Sequence: Synthetic peptide
YYDIL

SEQ ID NO: 4334 - protein, 5 aa, Artificial Sequence
  Description of Artificial Sequence: Synthetic peptide
YDILT

SEQ ID NO: 4335 - protein, 5 aa, Artificial Sequence
  Description of Artificial Sequence: Synthetic peptide
DILTG

SEQ ID NO: 4336 - protein, 5 aa, Artificial Sequence
  Description of Artificial Sequence: Synthetic peptide
ILTGY

SEQ ID NO: 4337 - protein, 5 aa, Artificial Sequence
  Description of Artificial Sequence: Synthetic peptide
LTGYY

SEQ ID NO: 4338 - protein, 5 aa, Artificial Sequence
  Description of Artificial Sequence: Synthetic peptide
TGYYN

SEQ ID NO: 4339 - protein, 4 aa, Artificial Sequence
  Description of Artificial Sequence: Synthetic peptide
YYDI

SEQ ID NO: 4340 - protein, 4 aa, Artificial Sequence
  Description of Artificial Sequence: Synthetic peptide
YDIL

SEQ ID NO: 4341 - protein, 4 aa, Artificial Sequence
  Description of Artificial Sequence: Synthetic peptide
DILT

SEQ ID NO: 4342 - protein, 4 aa, Artificial Sequence
  Description of Artificial Sequence: Synthetic peptide
ILTG

SEQ ID NO: 4343 - protein, 4 aa, Artificial Sequence
  Description of Artificial Sequence: Synthetic peptide
LTGY

SEQ ID NO: 4344 - protein, 4 aa, Artificial Sequence
  Description of Artificial Sequence: Synthetic peptide
TGYY

SEQ ID NO: 4345 - protein, 4 aa, Artificial Sequence
  Description of Artificial Sequence: Synthetic peptide
GYYN

SEQ ID NO: 4346 - protein, 5 aa, Artificial Sequence
  Description of Artificial Sequence: Synthetic peptide
LVIIT

SEQ ID NO: 4347 - protein, 4 aa, Artificial Sequence
  Description of Artificial Sequence: Synthetic peptide
LVII

SEQ ID NO: 4348 - protein, 5 aa, Artificial Sequence
  Description of Artificial Sequence: Synthetic peptide
DYGDY

SEQ ID NO: 4349 - protein, 4 aa, Artificial Sequence
  Description of Artificial Sequence: Synthetic peptide
DYGD

SEQ ID NO: 4350 - protein, 4 aa, Artificial Sequence
  Description of Artificial Sequence: Synthetic peptide
YGDY

SEQ ID NO: 4351 - protein, 5 aa, Artificial Sequence
  Description of Artificial Sequence: Synthetic peptide
TTVTT

SEQ ID NO: 4352 - protein, 4 aa, Artificial Sequence
  Description of Artificial Sequence: Synthetic peptide
TTVT

SEQ ID NO: 4353 - protein, 4 aa, Artificial Sequence
  Description of Artificial Sequence: Synthetic peptide
TVTT

SEQ ID NO: 4354 - protein, 6 aa, Artificial Sequence
  Description of Artificial Sequence: Synthetic peptide
DYGGNS

SEQ ID NO: 4355 - protein, 5 aa, Artificial Sequence
  Description of Artificial Sequence: Synthetic peptide
DYGGN

SEQ ID NO: 4356 - protein, 5 aa, Artificial Sequence
  Description of Artificial Sequence: Synthetic peptide
YGGNS

SEQ ID NO: 4357 - protein, 4 aa, Artificial Sequence
  Description of Artificial Sequence: Synthetic peptide
DYGG

SEQ ID NO: 4358 - protein, 4 aa, Artificial Sequence
  Description of Artificial Sequence: Synthetic peptide
YGGN

SEQ ID NO: 4359 - protein, 4 aa, Artificial Sequence
  Description of Artificial Sequence: Synthetic peptide
GGNS

SEQ ID NO: 4360 - protein, 6 aa, Artificial Sequence
  Description of Artificial Sequence: Synthetic peptide
TTVVTP

SEQ ID NO: 4361 - protein, 5 aa, Artificial Sequence
  Description of Artificial Sequence: Synthetic peptide
TTVVT

SEQ ID NO: 4362 - protein, 5 aa, Artificial Sequence
  Description of Artificial Sequence: Synthetic peptide
TVVTP

SEQ ID NO: 4363 - protein, 4 aa, Artificial Sequence
  Description of Artificial Sequence: Synthetic peptide
TTVV

SEQ ID NO: 4364 - protein, 4 aa, Artificial Sequence
  Description of Artificial Sequence: Synthetic peptide
TVVT

SEQ ID NO: 4365 - protein, 4 aa, Artificial Sequence
  Description of Artificial Sequence: Synthetic peptide
VVTP

SEQ ID NO: 4366 - protein, 5 aa, Artificial Sequence
  Description of Artificial Sequence: Synthetic peptide
DYSNY

SEQ ID NO: 4367 - protein, 4 aa, Artificial Sequence
  Description of Artificial Sequence: Synthetic peptide
DYSN

SEQ ID NO: 4368 - protein, 4 aa, Artificial Sequence
  Description of Artificial Sequence: Synthetic peptide
YSNY

SEQ ID NO: 4369 - protein, 8 aa, Artificial Sequence
  Description of Artificial Sequence: Synthetic peptide
VDIVATIT

SEQ ID NO: 4370 - protein, 7 aa, Artificial Sequence
  Description of Artificial Sequence: Synthetic peptide
VDIVATI

SEQ ID NO: 4371 - protein, 7 aa, Artificial Sequence
  Description of Artificial Sequence: Synthetic peptide
DIVATIT

SEQ ID NO: 4372 - protein, 6 aa, Artificial Sequence
  Description of Artificial Sequence: Synthetic peptide
VDIVAT

SEQ ID NO: 4373 - protein, 6 aa, Artificial Sequence
  Description of Artificial Sequence: Synthetic peptide
DIVATI

SEQ ID NO: 4374 - protein, 6 aa, Artificial Sequence
  Description of Artificial Sequence: Synthetic peptide
IVATIT

SEQ ID NO: 4375 - protein, 5 aa, Artificial Sequence
  Description of Artificial Sequence: Synthetic peptide
VDIVA

SEQ ID NO: 4376 - protein, 5 aa, Artificial Sequence
  Description of Artificial Sequence: Synthetic peptide
DIVAT

SEQ ID NO: 4377 - protein, 5 aa, Artificial Sequence
  Description of Artificial Sequence: Synthetic peptide
IVATI

SEQ ID NO: 4378 - protein, 5 aa, Artificial Sequence
  Description of Artificial Sequence: Synthetic peptide
VATIT

SEQ ID NO: 4379 - protein, 4 aa, Artificial Sequence
  Description of Artificial Sequence: Synthetic peptide
VDIV

SEQ ID NO: 4380 - protein, 4 aa, Artificial Sequence
  Description of Artificial Sequence: Synthetic peptide
DIVA

SEQ ID NO: 4381 - protein, 4 aa, Artificial Sequence
  Description of Artificial Sequence: Synthetic peptide
IVAT

SEQ ID NO: 4382 - protein, 4 aa, Artificial Sequence
  Description of Artificial Sequence: Synthetic peptide
VATI

SEQ ID NO: 4383 - protein, 4 aa, Artificial Sequence
  Description of Artificial Sequence: Synthetic peptide
ATIT

SEQ ID NO: 4384 - protein, 4 aa, Artificial Sequence
  Description of Artificial Sequence: Synthetic peptide
WLRL

SEQ ID NO: 4385 - protein, 7 aa, Artificial Sequence
  Description of Artificial Sequence: Synthetic peptide
GYSGYDY

SEQ ID NO: 4386 - protein, 6 aa, Artificial Sequence
  Description of Artificial Sequence: Synthetic peptide
GYSGYD

SEQ ID NO: 4387 - protein, 6 aa, Artificial Sequence
  Description of Artificial Sequence: Synthetic peptide
YSGYDY

SEQ ID NO: 4388 - protein, 5 aa, Artificial Sequence
  Description of Artificial Sequence: Synthetic peptide
GYSGY

SEQ ID NO: 4389 - protein, 5 aa, Artificial Sequence
  Description of Artificial Sequence: Synthetic peptide
YSGYD

SEQ ID NO: 4390 - protein, 5 aa, Artificial Sequence
  Description of Artificial Sequence: Synthetic peptide
SGYDY

SEQ ID NO: 4391 - protein, 4 aa, Artificial Sequence
  Description of Artificial Sequence: Synthetic peptide
GYSG

SEQ ID NO: 4392 - protein, 4 aa, Artificial Sequence
  Description of Artificial Sequence: Synthetic peptide
YSGY

SEQ ID NO: 4393 - protein, 4 aa, Artificial Sequence
  Description of Artificial Sequence: Synthetic peptide
SGYD

SEQ ID NO: 4394 - protein, 4 aa, Artificial Sequence
  Description of Artificial Sequence: Synthetic peptide
GYDY

SEQ ID NO: 4395 - protein, 7 aa, Artificial Sequence
  Description of Artificial Sequence: Synthetic peptide
VEMATIT

SEQ ID NO: 4396 - protein, 6 aa, Artificial Sequence
  Description of Artificial Sequence: Synthetic peptide
VEMATI

SEQ ID NO: 4397 - protein, 6 aa, Artificial Sequence
  Description of Artificial Sequence: Synthetic peptide
EMATIT

SEQ ID NO: 4398 - protein, 5 aa, Artificial Sequence
  Description of Artificial Sequence: Synthetic peptide
VEMAT

SEQ ID NO: 4399 - protein, 5 aa, Artificial Sequence
  Description of Artificial Sequence: Synthetic peptide
EMATI

SEQ ID NO: 4400 - protein, 5 aa, Artificial Sequence
  Description of Artificial Sequence: Synthetic peptide
MATIT

SEQ ID NO: 4401 - protein, 4 aa, Artificial Sequence
  Description of Artificial Sequence: Synthetic peptide
VEMA

SEQ ID NO: 4402 - protein, 4 aa, Artificial Sequence
  Description of Artificial Sequence: Synthetic peptide
EMAT

SEQ ID NO: 4403 - protein, 4 aa, Artificial Sequence
  Description of Artificial Sequence: Synthetic peptide
MATI

SEQ ID NO: 4404 - protein, 5 aa, Artificial Sequence
  Description of Artificial Sequence: Synthetic peptide
RWLQL

SEQ ID NO: 4405 - protein, 4 aa, Artificial Sequence
  Description of Artificial Sequence: Synthetic peptide
RWLQ

SEQ ID NO: 4406 - protein, 4 aa, Artificial Sequence
  Description of Artificial Sequence: Synthetic peptide
WLQL

SEQ ID NO: 4407 - protein, 6 aa, Artificial Sequence
  Description of Artificial Sequence: Synthetic peptide
RDGYNY

SEQ ID NO: 4408 - protein, 5 aa, Artificial Sequence
  Description of Artificial Sequence: Synthetic peptide
RDGYN

SEQ ID NO: 4409 - protein, 5 aa, Artificial Sequence
  Description of Artificial Sequence: Synthetic peptide
DGYNY

SEQ ID NO: 4410 - protein, 4 aa, Artificial Sequence
  Description of Artificial Sequence: Synthetic peptide
RDGY

SEQ ID NO: 4411 - protein, 4 aa, Artificial Sequence
  Description of Artificial Sequence: Synthetic peptide
DGYN

SEQ ID NO: 4412 - protein, 4 aa, Artificial Sequence
  Description of Artificial Sequence: Synthetic peptide
GYNY

SEQ ID NO: 4413 - protein, 7 aa, Artificial Sequence
  Description of Artificial Sequence: Synthetic peptide
VDTAMVT

SEQ ID NO: 4414 - protein, 6 aa, Artificial Sequence
  Description of Artificial Sequence: Synthetic peptide
VDTAMV

SEQ ID NO: 4415 - protein, 6 aa, Artificial Sequence
  Description of Artificial Sequence: Synthetic peptide
DTAMVT

SEQ ID NO: 4416 - protein, 5 aa, Artificial Sequence
  Description of Artificial Sequence: Synthetic peptide
VDTAM

SEQ ID NO: 4417 - protein, 5 aa, Artificial Sequence
  Description of Artificial Sequence: Synthetic peptide
DTAMV

SEQ ID NO: 4418 - protein, 5 aa, Artificial Sequence
  Description of Artificial Sequence: Synthetic peptide
TAMVT

SEQ ID NO: 4419 - protein, 4 aa, Artificial Sequence
  Description of Artificial Sequence: Synthetic peptide
VDTA

SEQ ID NO: 4420 - protein, 4 aa, Artificial Sequence
  Description of Artificial Sequence: Synthetic peptide
DTAM

SEQ ID NO: 4421 - protein, 4 aa, Artificial Sequence
  Description of Artificial Sequence: Synthetic peptide
TAMV

SEQ ID NO: 4422 - protein, 4 aa, Artificial Sequence
  Description of Artificial Sequence: Synthetic peptide
AMVT

SEQ ID NO: 4423 - protein, 6 aa, Artificial Sequence
  Description of Artificial Sequence: Synthetic peptide
WIQLWL

SEQ ID NO: 4424 - protein, 5 aa, Artificial Sequence
  Description of Artificial Sequence: Synthetic peptide
WIQLW

SEQ ID NO: 4425 - protein, 5 aa, Artificial Sequence
  Description of Artificial Sequence: Synthetic peptide
IQLWL

SEQ ID NO: 4426 - protein, 4 aa, Artificial Sequence
  Description of Artificial Sequence: Synthetic peptide
WIQL

SEQ ID NO: 4427 - protein, 4 aa, Artificial Sequence
  Description of Artificial Sequence: Synthetic peptide
IQLW

SEQ ID NO: 4428 - protein, 4 aa, Artificial Sequence
  Description of Artificial Sequence: Synthetic peptide
QLWL

SEQ ID NO: 4429 - protein, 6 aa, Artificial Sequence
  Description of Artificial Sequence: Synthetic peptide
GYSYGY

SEQ ID NO: 4430 - protein, 5 aa, Artificial Sequence
  Description of Artificial Sequence: Synthetic peptide
GYSYG

SEQ ID NO: 4431 - protein, 5 aa, Artificial Sequence
  Description of Artificial Sequence: Synthetic peptide
YSYGY

SEQ ID NO: 4432 - protein, 4 aa, Artificial Sequence
  Description of Artificial Sequence: Synthetic peptide
GYSY

SEQ ID NO: 4433 - protein, 4 aa, Artificial Sequence
  Description of Artificial Sequence: Synthetic peptide
YSYG

SEQ ID NO: 4434 - protein, 4 aa, Artificial Sequence
  Description of Artificial Sequence: Synthetic peptide
SYGY

SEQ ID NO: 4435 - protein, 7 aa, Artificial Sequence
  Description of Artificial Sequence: Synthetic peptide
GYSSSWY

SEQ ID NO: 4436 - protein, 6 aa, Artificial Sequence
  Description of Artificial Sequence: Synthetic peptide
GYSSSW

SEQ ID NO: 4437 - protein, 6 aa, Artificial Sequence
  Description of Artificial Sequence: Synthetic peptide
YSSSWY

SEQ ID NO: 4438 - protein, 5 aa, Artificial Sequence
  Description of Artificial Sequence: Synthetic peptide
GYSSS

SEQ ID NO: 4439 - protein, 5 aa, Artificial Sequence
  Description of Artificial Sequence: Synthetic peptide
YSSSW

SEQ ID NO: 4440 - protein, 5 aa, Artificial Sequence
  Description of Artificial Sequence: Synthetic peptide
SSSWY

SEQ ID NO: 4441 - protein, 4 aa, Artificial Sequence
  Description of Artificial Sequence: Synthetic peptide
GYSS

SEQ ID NO: 4442 - protein, 4 aa, Artificial Sequence
  Description of Artificial Sequence: Synthetic peptide
YSSS

SEQ ID NO: 4443 - protein, 4 aa, Artificial Sequence
  Description of Artificial Sequence: Synthetic peptide
SSSW

SEQ ID NO: 4444 - protein, 4 aa, Artificial Sequence
  Description of Artificial Sequence: Synthetic peptide
SSWY

SEQ ID NO: 4445 - protein, 7 aa, Artificial Sequence
  Description of Artificial Sequence: Synthetic peptide
GIAAAGT

SEQ ID NO: 4446 - protein, 6 aa, Artificial Sequence
  Description of Artificial Sequence: Synthetic peptide
GIAAAG

SEQ ID NO: 4447 - protein, 6 aa, Artificial Sequence
  Description of Artificial Sequence: Synthetic peptide
IAAAGT

SEQ ID NO: 4448 - protein, 5 aa, Artificial Sequence
  Description of Artificial Sequence: Synthetic peptide
GIAAA

SEQ ID NO: 4449 - protein, 5 aa, Artificial Sequence
  Description of Artificial Sequence: Synthetic peptide
IAAAG

SEQ ID NO: 4450 - protein, 5 aa, Artificial Sequence
  Description of Artificial Sequence: Synthetic peptide
AAAGT

SEQ ID NO: 4451 - protein, 4 aa, Artificial Sequence
  Description of Artificial Sequence: Synthetic peptide
GIAA

SEQ ID NO: 4452 - protein, 4 aa, Artificial Sequence
  Description of Artificial Sequence: Synthetic peptide
IAAA

SEQ ID NO: 4453 - protein, 4 aa, Artificial Sequence
  Description of Artificial Sequence: Synthetic peptide
AAAG

SEQ ID NO: 4454 - protein, 4 aa, Artificial Sequence
  Description of Artificial Sequence: Synthetic peptide
AAGT

SEQ ID NO: 4455 - protein, 4 aa, Artificial Sequence
  Description of Artificial Sequence: Synthetic peptide
QQLV

SEQ ID NO: 4456 - protein, 7 aa, Artificial Sequence
  Description of Artificial Sequence: Synthetic peptide
GYSSGWY

SEQ ID NO: 4457 - protein, 6 aa, Artificial Sequence
  Description of Artificial Sequence: Synthetic peptide
GYSSGW

SEQ ID NO: 4458 - protein, 6 aa, Artificial Sequence
  Description of Artificial Sequence: Synthetic peptide
YSSGWY

SEQ ID NO: 4459 - protein, 5 aa, Artificial Sequence
  Description of Artificial Sequence: Synthetic peptide
GYSSG

SEQ ID NO: 4460 - protein, 5 aa, Artificial Sequence
  Description of Artificial Sequence: Synthetic peptide
YSSGW

SEQ ID NO: 4461 - protein, 5 aa, Artificial Sequence
  Description of Artificial Sequence: Synthetic peptide
SSGWY

SEQ ID NO: 4462 - protein, 4 aa, Artificial Sequence
  Description of Artificial Sequence: Synthetic peptide
YSSG

SEQ ID NO: 4463 - protein, 4 aa, Artificial Sequence
  Description of Artificial Sequence: Synthetic peptide
SSGW

SEQ ID NO: 4464 - protein, 4 aa, Artificial Sequence
  Description of Artificial Sequence: Synthetic peptide
SGWY

SEQ ID NO: 4465 - protein, 7 aa, Artificial Sequence
  Description of Artificial Sequence: Synthetic peptide
GIAVAGT

SEQ ID NO: 4466 - protein, 6 aa, Artificial Sequence
  Description of Artificial Sequence: Synthetic peptide
GIAVAG

SEQ ID NO: 4467 - protein, 6 aa, Artificial Sequence
  Description of Artificial Sequence: Synthetic peptide
IAVAGT

SEQ ID NO: 4468 - protein, 5 aa, Artificial Sequence
  Description of Artificial Sequence: Synthetic peptide
GIAVA

SEQ ID NO: 4469 - protein, 5 aa, Artificial Sequence
  Description of Artificial Sequence: Synthetic peptide
IAVAG

SEQ ID NO: 4470 - protein, 5 aa, Artificial Sequence
  Description of Artificial Sequence: Synthetic peptide
AVAGT

SEQ ID NO: 4471 - protein, 4 aa, Artificial Sequence
  Description of Artificial Sequence: Synthetic peptide
GIAV

SEQ ID NO: 4472 - protein, 4 aa, Artificial Sequence
  Description of Artificial Sequence: Synthetic peptide
IAVA

SEQ ID NO: 4473 - protein, 4 aa, Artificial Sequence
  Description of Artificial Sequence: Synthetic peptide
AVAG

SEQ ID NO: 4474 - protein, 4 aa, Artificial Sequence
  Description of Artificial Sequence: Synthetic peptide
VAGT

SEQ ID NO: 4475 - protein, 4 aa, Artificial Sequence
  Description of Artificial Sequence: Synthetic peptide
QWLV

SEQ ID NO: 4476 - protein, 6 aa, Artificial Sequence
  Description of Artificial Sequence: Synthetic peptide
EYSSSS

SEQ ID NO: 4477 - protein, 5 aa, Artificial Sequence
  Description of Artificial Sequence: Synthetic peptide
EYSSS

SEQ ID NO: 4478 - protein, 5 aa, Artificial Sequence
  Description of Artificial Sequence: Synthetic peptide
YSSSS

SEQ ID NO: 4479 - protein, 4 aa, Artificial Sequence
  Description of Artificial Sequence: Synthetic peptide
EYSS

SEQ ID NO: 4480 - protein, 4 aa, Artificial Sequence
  Description of Artificial Sequence: Synthetic peptide
SSSS

SEQ ID NO: 4481 - protein, 6 aa, Artificial Sequence
  Description of Artificial Sequence: Synthetic peptide
SIAARP

SEQ ID NO: 4482 - protein, 5 aa, Artificial Sequence
  Description of Artificial Sequence: Synthetic peptide
SIAAR

SEQ ID NO: 4483 - protein, 5 aa, Artificial Sequence
  Description of Artificial Sequence: Synthetic peptide
IAARP

SEQ ID NO: 4484 - protein, 4 aa, Artificial Sequence
  Description of Artificial Sequence: Synthetic peptide
SIAA

SEQ ID NO: 4485 - protein, 4 aa, Artificial Sequence
  Description of Artificial Sequence: Synthetic peptide
IAAR

SEQ ID NO: 4486 - protein, 4 aa, Artificial Sequence
  Description of Artificial Sequence: Synthetic peptide
AARP

SEQ ID NO: 4487 - protein, 6 aa, Artificial Sequence
  Description of Artificial Sequence: Synthetic peptide
TEYFQH

SEQ ID NO: 4488 - protein, 5 aa, Artificial Sequence
  Description of Artificial Sequence: Synthetic peptide
EYFQH

SEQ ID NO: 4489 - protein, 4 aa, Artificial Sequence
  Description of Artificial Sequence: Synthetic peptide
YFQH

SEQ ID NO: 4490 - protein, 6 aa, Artificial Sequence
  Description of Artificial Sequence: Synthetic peptide
SEYFQH

SEQ ID NO: 4491 - protein, 6 aa, Artificial Sequence
  Description of Artificial Sequence: Synthetic peptide
PEYFQH

SEQ ID NO: 4492 - protein, 6 aa, Artificial Sequence
  Description of Artificial Sequence: Synthetic peptide
FEYFQH

SEQ ID NO: 4493 - protein, 6 aa, Artificial Sequence
  Description of Artificial Sequence: Synthetic peptide
HEYFQH

SEQ ID NO: 4494 - protein, 6 aa, Artificial Sequence
  Description of Artificial Sequence: Synthetic peptide
REYFQH

SEQ ID NO: 4495 - protein, 6 aa, Artificial Sequence
  Description of Artificial Sequence: Synthetic peptide
LEYFQH

SEQ ID NO: 4496 - protein, 6 aa, Artificial Sequence
  Description of Artificial Sequence: Synthetic peptide
NEYFQH

SEQ ID NO: 4497 - protein, 6 aa, Artificial Sequence
  Description of Artificial Sequence: Synthetic peptide
IEYFQH

SEQ ID NO: 4498 - protein, 6 aa, Artificial Sequence
  Description of Artificial Sequence: Synthetic peptide
DEYFQH

SEQ ID NO: 4499 - protein, 6 aa, Artificial Sequence
  Description of Artificial Sequence: Synthetic peptide
GEYFQH

SEQ ID NO: 4500 - protein, 6 aa, Artificial Sequence
  Description of Artificial Sequence: Synthetic peptide
VEYFQH

SEQ ID NO: 4501 - protein, 6 aa, Artificial Sequence
  Description of Artificial Sequence: Synthetic peptide
YEYFQH

SEQ ID NO: 4502 - protein, 5 aa, Artificial Sequence
  Description of Artificial Sequence: Synthetic peptide
KYFQH

SEQ ID NO: 4503 - protein, 5 aa, Artificial Sequence
  Description of Artificial Sequence: Synthetic peptide
QYFQH

SEQ ID NO: 4504 - protein, 5 aa, Artificial Sequence
  Description of Artificial Sequence: Synthetic peptide
LYFQH

SEQ ID NO: 4505 - protein, 5 aa, Artificial Sequence
  Description of Artificial Sequence: Synthetic peptide
SYFQH

SEQ ID NO: 4506 - protein, 5 aa, Artificial Sequence
  Description of Artificial Sequence: Synthetic peptide
RYFQH

SEQ ID NO: 4507 - protein, 5 aa, Artificial Sequence
  Description of Artificial Sequence: Synthetic peptide
PYFQH

SEQ ID NO: 4508 - protein, 5 aa, Artificial Sequence
  Description of Artificial Sequence: Synthetic peptide
IYFQH

SEQ ID NO: 4509 - protein, 5 aa, Artificial Sequence
  Description of Artificial Sequence: Synthetic peptide
TYFQH

SEQ ID NO: 4510 - protein, 5 aa, Artificial Sequence
  Description of Artificial Sequence: Synthetic peptide
GYFQH

SEQ ID NO: 4511 - protein, 5 aa, Artificial Sequence
  Description of Artificial Sequence: Synthetic peptide
VYFQH

SEQ ID NO: 4512 - protein, 5 aa, Artificial Sequence
  Description of Artificial Sequence: Synthetic peptide
AYFQH

SEQ ID NO: 4513 - protein, 4 aa, Artificial Sequence
  Description of Artificial Sequence: Synthetic peptide
NFQH

SEQ ID NO: 4514 - protein, 4 aa, Artificial Sequence
  Description of Artificial Sequence: Synthetic peptide
DFQH

SEQ ID NO: 4515 - protein, 4 aa, Artificial Sequence
  Description of Artificial Sequence: Synthetic peptide
HFQH

SEQ ID NO: 4516 - protein, 4 aa, Artificial Sequence
  Description of Artificial Sequence: Synthetic peptide
FFQH

SEQ ID NO: 4517 - protein, 4 aa, Artificial Sequence
  Description of Artificial Sequence: Synthetic peptide
SFQH

SEQ ID NO: 4518 - protein, 4 aa, Artificial Sequence
  Description of Artificial Sequence: Synthetic peptide
RFQH

SEQ ID NO: 4519 - protein, 4 aa, Artificial Sequence
  Description of Artificial Sequence: Synthetic peptide
LFQH

SEQ ID NO: 4520 - protein, 4 aa, Artificial Sequence
  Description of Artificial Sequence: Synthetic peptide
PFQH

SEQ ID NO: 4521 - protein, 4 aa, Artificial Sequence
  Description of Artificial Sequence: Synthetic peptide
IFQH

SEQ ID NO: 4522 - protein, 4 aa, Artificial Sequence
  Description of Artificial Sequence: Synthetic peptide
TFQH

SEQ ID NO: 4523 - protein, 4 aa, Artificial Sequence
  Description of Artificial Sequence: Synthetic peptide
GFQH

SEQ ID NO: 4524 - protein, 4 aa, Artificial Sequence
  Description of Artificial Sequence: Synthetic peptide
VFQH

SEQ ID NO: 4525 - protein, 4 aa, Artificial Sequence
  Description of Artificial Sequence: Synthetic peptide
AFQH

SEQ ID NO: 4526 - protein, 6 aa, Artificial Sequence
  Description of Artificial Sequence: Synthetic peptide
AEYFQH

SEQ ID NO: 4527 - protein, 6 aa, Artificial Sequence
  Description of Artificial Sequence: Synthetic peptide
YWYFDL

SEQ ID NO: 4528 - protein, 5 aa, Artificial Sequence
  Description of Artificial Sequence: Synthetic peptide
WYFDL

SEQ ID NO: 4529 - protein, 4 aa, Artificial Sequence
  Description of Artificial Sequence: Synthetic peptide
YFDL

SEQ ID NO: 4530 - protein, 6 aa, Artificial Sequence
  Description of Artificial Sequence: Synthetic peptide
DWYFDL

SEQ ID NO: 4531 - protein, 6 aa, Artificial Sequence
  Description of Artificial Sequence: Synthetic peptide
HWYFDL

SEQ ID NO: 4532 - protein, 6 aa, Artificial Sequence
  Description of Artificial Sequence: Synthetic peptide
NWYFDL

SEQ ID NO: 4533 - protein, 5 aa, Artificial Sequence
  Description of Artificial Sequence: Synthetic peptide
GYFDL

SEQ ID NO: 4534 - protein, 5 aa, Artificial Sequence
  Description of Artificial Sequence: Synthetic peptide
RYFDL

SEQ ID NO: 4535 - protein, 4 aa, Artificial Sequence
  Description of Artificial Sequence: Synthetic peptide
HFDL

SEQ ID NO: 4536 - protein, 4 aa, Artificial Sequence
  Description of Artificial Sequence: Synthetic peptide
NFDL

SEQ ID NO: 4537 - protein, 4 aa, Artificial Sequence
  Description of Artificial Sequence: Synthetic peptide
DFDL

SEQ ID NO: 4538 - protein, 5 aa, Artificial Sequence
  Description of Artificial Sequence: Synthetic peptide
DAFDI

SEQ ID NO: 4539 - protein, 4 aa, Artificial Sequence
  Description of Artificial Sequence: Synthetic peptide
AFDI

SEQ ID NO: 4540 - protein, 5 aa, Artificial Sequence
  Description of Artificial Sequence: Synthetic peptide
YAFDI

SEQ ID NO: 4541 - protein, 5 aa, Artificial Sequence
  Description of Artificial Sequence: Synthetic peptide
HAFDI

SEQ ID NO: 4542 - protein, 5 aa, Artificial Sequence
  Description of Artificial Sequence: Synthetic peptide
FAFDI

SEQ ID NO: 4543 - protein, 5 aa, Artificial Sequence
  Description of Artificial Sequence: Synthetic peptide
SAFDI

SEQ ID NO: 4544 - protein, 5 aa, Artificial Sequence
  Description of Artificial Sequence: Synthetic peptide
RAFDI

SEQ ID NO: 4545 - protein, 5 aa, Artificial Sequence
  Description of Artificial Sequence: Synthetic peptide
LAFDI

SEQ ID NO: 4546 - protein, 5 aa, Artificial Sequence
  Description of Artificial Sequence: Synthetic peptide
PAFDI

SEQ ID NO: 4547 - protein, 5 aa, Artificial Sequence
  Description of Artificial Sequence: Synthetic peptide
IAFDI

SEQ ID NO: 4548 - protein, 5 aa, Artificial Sequence
  Description of Artificial Sequence: Synthetic peptide
TAFDI

SEQ ID NO: 4549 - protein, 5 aa, Artificial Sequence
  Description of Artificial Sequence: Synthetic peptide
GAFDI

SEQ ID NO: 4550 - protein, 5 aa, Artificial Sequence
  Description of Artificial Sequence: Synthetic peptide
VAFDI

SEQ ID NO: 4551 - protein, 5 aa, Artificial Sequence
  Description of Artificial Sequence: Synthetic peptide
AAFDI

SEQ ID NO: 4552 - protein, 4 aa, Artificial Sequence
  Description of Artificial Sequence: Synthetic peptide
TFDI

SEQ ID NO: 4553 - protein, 4 aa, Artificial Sequence
  Description of Artificial Sequence: Synthetic peptide
SFDI

SEQ ID NO: 4554 - protein, 4 aa, Artificial Sequence
  Description of Artificial Sequence: Synthetic peptide
PFDI

SEQ ID NO: 4555 - protein, 4 aa, Artificial Sequence
  Description of Artificial Sequence: Synthetic peptide
FFDI

SEQ ID NO: 4556 - protein, 4 aa, Artificial Sequence
  Description of Artificial Sequence: Synthetic peptide
HFDI

SEQ ID NO: 4557 - protein, 4 aa, Artificial Sequence
  Description of Artificial Sequence: Synthetic peptide
RFDI

SEQ ID NO: 4558 - protein, 4 aa, Artificial Sequence
  Description of Artificial Sequence: Synthetic peptide
LFDI

SEQ ID NO: 4559 - protein, 4 aa, Artificial Sequence
  Description of Artificial Sequence: Synthetic peptide
NFDI

SEQ ID NO: 4560 - protein, 4 aa, Artificial Sequence
  Description of Artificial Sequence: Synthetic peptide
IFDI

SEQ ID NO: 4561 - protein, 4 aa, Artificial Sequence
  Description of Artificial Sequence: Synthetic peptide
DFDI

SEQ ID NO: 4562 - protein, 4 aa, Artificial Sequence
  Description of Artificial Sequence: Synthetic peptide
GFDI

SEQ ID NO: 4563 - protein, 4 aa, Artificial Sequence
  Description of Artificial Sequence: Synthetic peptide
VFDI

SEQ ID NO: 4564 - protein, 4 aa, Artificial Sequence
  Description of Artificial Sequence: Synthetic peptide
YFDI

SEQ ID NO: 4565 - protein, 5 aa, Artificial Sequence
  Description of Artificial Sequence: Synthetic peptide
NAFDI

SEQ ID NO: 4566 - protein, 5 aa, Artificial Sequence
  Description of Artificial Sequence: Synthetic peptide
DYFDY

SEQ ID NO: 4567 - protein, 4 aa, Artificial Sequence
  Description of Artificial Sequence: Synthetic peptide
YFDY

SEQ ID NO: 4568 - protein, 5 aa, Artificial Sequence
  Description of Artificial Sequence: Synthetic peptide
YYFDY

SEQ ID NO: 4569 - protein, 5 aa, Artificial Sequence
  Description of Artificial Sequence: Synthetic peptide
HYFDY

SEQ ID NO: 4570 - protein, 5 aa, Artificial Sequence
  Description of Artificial Sequence: Synthetic peptide
FYFDY

SEQ ID NO: 4571 - protein, 5 aa, Artificial Sequence
  Description of Artificial Sequence: Synthetic peptide
SYFDY

SEQ ID NO: 4572 - protein, 5 aa, Artificial Sequence
  Description of Artificial Sequence: Synthetic peptide
RYFDY

SEQ ID NO: 4573 - protein, 5 aa, Artificial Sequence
  Description of Artificial Sequence: Synthetic peptide
LYFDY

SEQ ID NO: 4574 - protein, 5 aa, Artificial Sequence
  Description of Artificial Sequence: Synthetic peptide
PYFDY

SEQ ID NO: 4575 - protein, 5 aa, Artificial Sequence
  Description of Artificial Sequence: Synthetic peptide
IYFDY

SEQ ID NO: 4576 - protein, 5 aa, Artificial Sequence
  Description of Artificial Sequence: Synthetic peptide
TYFDY

SEQ ID NO: 4577 - protein, 5 aa, Artificial Sequence
  Description of Artificial Sequence: Synthetic peptide
GYFDY

SEQ ID NO: 4578 - protein, 5 aa, Artificial Sequence
  Description of Artificial Sequence: Synthetic peptide
VYFDY

SEQ ID NO: 4579 - protein, 5 aa, Artificial Sequence
  Description of Artificial Sequence: Synthetic peptide
AYFDY

SEQ ID NO: 4580 - protein, 4 aa, Artificial Sequence
  Description of Artificial Sequence: Synthetic peptide
NFDY

SEQ ID NO: 4581 - protein, 4 aa, Artificial Sequence
  Description of Artificial Sequence: Synthetic peptide
DFDY

SEQ ID NO: 4582 - protein, 4 aa, Artificial Sequence
  Description of Artificial Sequence: Synthetic peptide
HFDY

SEQ ID NO: 4583 - protein, 4 aa, Artificial Sequence
  Description of Artificial Sequence: Synthetic peptide
FFDY

SEQ ID NO: 4584 - protein, 4 aa, Artificial Sequence
  Description of Artificial Sequence: Synthetic peptide
SFDY

SEQ ID NO: 4585 - protein, 4 aa, Artificial Sequence
  Description of Artificial Sequence: Synthetic peptide
RFDY

SEQ ID NO: 4586 - protein, 4 aa, Artificial Sequence
  Description of Artificial Sequence: Synthetic peptide
LFDY

SEQ ID NO: 4587 - protein, 4 aa, Artificial Sequence
  Description of Artificial Sequence: Synthetic peptide
PFDY

SEQ ID NO: 4588 - protein, 4 aa, Artificial Sequence
  Description of Artificial Sequence: Synthetic peptide
IFDY

SEQ ID NO: 4589 - protein, 4 aa, Artificial Sequence
  Description of Artificial Sequence: Synthetic peptide
TFDY

SEQ ID NO: 4590 - protein, 4 aa, Artificial Sequence
  Description of Artificial Sequence: Synthetic peptide
GFDY

SEQ ID NO: 4591 - protein, 4 aa, Artificial Sequence
  Description of Artificial Sequence: Synthetic peptide
VFDY

SEQ ID NO: 4592 - protein, 4 aa, Artificial Sequence
  Description of Artificial Sequence: Synthetic peptide
AFDY

SEQ ID NO: 4593 - protein, 5 aa, Artificial Sequence
  Description of Artificial Sequence: Synthetic peptide
NYFDY

SEQ ID NO: 4594 - protein, 6 aa, Artificial Sequence
  Description of Artificial Sequence: Synthetic peptide
DNWFDP

SEQ ID NO: 4595 - protein, 5 aa, Artificial Sequence
  Description of Artificial Sequence: Synthetic peptide
NWFDP

SEQ ID NO: 4596 - protein, 4 aa, Artificial Sequence
  Description of Artificial Sequence: Synthetic peptide
WFDP

SEQ ID NO: 4597 - protein, 6 aa, Artificial Sequence
  Description of Artificial Sequence: Synthetic peptide
YNWFDP

SEQ ID NO: 4598 - protein, 6 aa, Artificial Sequence
  Description of Artificial Sequence: Synthetic peptide
HNWFDP

SEQ ID NO: 4599 - protein, 6 aa, Artificial Sequence
  Description of Artificial Sequence: Synthetic peptide
FNWFDP

SEQ ID NO: 4600 - protein, 6 aa, Artificial Sequence
  Description of Artificial Sequence: Synthetic peptide
SNWFDP

SEQ ID NO: 4601 - protein, 6 aa, Artificial Sequence
  Description of Artificial Sequence: Synthetic peptide
RNWFDP

SEQ ID NO: 4602 - protein, 6 aa, Artificial Sequence
  Description of Artificial Sequence: Synthetic peptide
LNWFDP

SEQ ID NO: 4603 - protein, 6 aa, Artificial Sequence
  Description of Artificial Sequence: Synthetic peptide
PNWFDP

SEQ ID NO: 4604 - protein, 6 aa, Artificial Sequence
  Description of Artificial Sequence: Synthetic peptide
INWFDP

SEQ ID NO: 4605 - protein, 6 aa, Artificial Sequence
  Description of Artificial Sequence: Synthetic peptide
TNWFDP

SEQ ID NO: 4606 - protein, 6 aa, Artificial Sequence
  Description of Artificial Sequence: Synthetic peptide
GNWFDP

SEQ ID NO: 4607 - protein, 6 aa, Artificial Sequence
  Description of Artificial Sequence: Synthetic peptide
VNWFDP

SEQ ID NO: 4608 - protein, 6 aa, Artificial Sequence
  Description of Artificial Sequence: Synthetic peptide
ANWFDP

SEQ ID NO: 4609 - protein, 5 aa, Artificial Sequence
  Description of Artificial Sequence: Synthetic peptide
DWFDP

SEQ ID NO: 4610 - protein, 5 aa, Artificial Sequence
  Description of Artificial Sequence: Synthetic peptide
YWFDP

SEQ ID NO: 4611 - protein, 5 aa, Artificial Sequence
  Description of Artificial Sequence: Synthetic peptide
HWFDP

SEQ ID NO: 4612 - protein, 5 aa, Artificial Sequence
  Description of Artificial Sequence: Synthetic peptide
FWFDP

SEQ ID NO: 4613 - protein, 5 aa, Artificial Sequence
  Description of Artificial Sequence: Synthetic peptide
SWFDP

SEQ ID NO: 4614 - protein, 5 aa, Artificial Sequence
  Description of Artificial Sequence: Synthetic peptide
RWFDP

SEQ ID NO: 4615 - protein, 5 aa, Artificial Sequence
  Description of Artificial Sequence: Synthetic peptide
LWFDP

SEQ ID NO: 4616 - protein, 5 aa, Artificial Sequence
  Description of Artificial Sequence: Synthetic peptide
PWFDP

SEQ ID NO: 4617 - protein, 5 aa, Artificial Sequence
  Description of Artificial Sequence: Synthetic peptide
IWFDP

SEQ ID NO: 4618 - protein, 5 aa, Artificial Sequence
  Description of Artificial Sequence: Synthetic peptide
TWFDP

SEQ ID NO: 4619 - protein, 5 aa, Artificial Sequence
  Description of Artificial Sequence: Synthetic peptide
GWFDP

SEQ ID NO: 4620 - protein, 5 aa, Artificial Sequence
  Description of Artificial Sequence: Synthetic peptide
VWFDP

SEQ ID NO: 4621 - protein, 5 aa, Artificial Sequence
  Description of Artificial Sequence: Synthetic peptide
AWFDP

SEQ ID NO: 4622 - protein, 4 aa, Artificial Sequence
  Description of Artificial Sequence: Synthetic peptide
RFDP

SEQ ID NO: 4623 - protein, 4 aa, Artificial Sequence
  Description of Artificial Sequence: Synthetic peptide
GFDP

SEQ ID NO: 4624 - protein, 4 aa, Artificial Sequence
  Description of Artificial Sequence: Synthetic peptide
LFDP

SEQ ID NO: 4625 - protein, 4 aa, Artificial Sequence
  Description of Artificial Sequence: Synthetic peptide
SFDP

SEQ ID NO: 4626 - protein, 4 aa, Artificial Sequence
  Description of Artificial Sequence: Synthetic peptide
QFDP

SEQ ID NO: 4627 - protein, 4 aa, Artificial Sequence
  Description of Artificial Sequence: Synthetic peptide
PFDP

SEQ ID NO: 4628 - protein, 4 aa, Artificial Sequence
  Description of Artificial Sequence: Synthetic peptide
KFDP

SEQ ID NO: 4629 - protein, 4 aa, Artificial Sequence
  Description of Artificial Sequence: Synthetic peptide
MFDP

SEQ ID NO: 4630 - protein, 4 aa, Artificial Sequence
  Description of Artificial Sequence: Synthetic peptide
TFDP

SEQ ID NO: 4631 - protein, 4 aa, Artificial Sequence
  Description of Artificial Sequence: Synthetic peptide
EFDP

SEQ ID NO: 4632 - protein, 4 aa, Artificial Sequence
  Description of Artificial Sequence: Synthetic peptide
VFDP

SEQ ID NO: 4633 - protein, 4 aa, Artificial Sequence
  Description of Artificial Sequence: Synthetic peptide
AFDP

SEQ ID NO: 4634 - protein, 6 aa, Artificial Sequence
  Description of Artificial Sequence: Synthetic peptide
NNWFDP

SEQ ID NO: 4635 - protein, 10 aa, Artificial Sequence
  Description of Artificial Sequence: Synthetic peptide
DYYYYYGMDV

SEQ ID NO: 4636 - protein, 9 aa, Artificial Sequence
  Description of Artificial Sequence: Synthetic peptide
YYYYYGMDV

SEQ ID NO: 4637 - protein, 8 aa, Artificial Sequence
  Description of Artificial Sequence: Synthetic peptide
YYYYGMDV

SEQ ID NO: 4638 - protein, 7 aa, Artificial Sequence
  Description of Artificial Sequence: Synthetic peptide
YYYGMDV

SEQ ID NO: 4639 - protein, 6 aa, Artificial Sequence
  Description of Artificial Sequence: Synthetic peptide
YYGMDV

SEQ ID NO: 4640 - protein, 5 aa, Artificial Sequence
  Description of Artificial Sequence: Synthetic peptide
YGMDV

SEQ ID NO: 4641 - protein, 4 aa, Artificial Sequence
  Description of Artificial Sequence: Synthetic peptide
GMDV

SEQ ID NO: 4642 - protein, 10 aa, Artificial Sequence
  Description of Artificial Sequence: Synthetic peptide
YYYYYYGMDV

SEQ ID NO: 4643 - protein, 10 aa, Artificial Sequence
  Description of Artificial Sequence: Synthetic peptide
HYYYYYGMDV

SEQ ID NO: 4644 - protein, 10 aa, Artificial Sequence
  Description of Artificial Sequence: Synthetic peptide
FYYYYYGMDV

SEQ ID NO: 4645 - protein, 10 aa, Artificial Sequence
  Description of Artificial Sequence: Synthetic peptide
SYYYYYGMDV

SEQ ID NO: 4646 - protein, 10 aa, Artificial Sequence
  Description of Artificial Sequence: Synthetic peptide
RYYYYYGMDV

SEQ ID NO: 4647 - protein, 10 aa, Artificial Sequence
  Description of Artificial Sequence: Synthetic peptide
LYYYYYGMDV

SEQ ID NO: 4648 - protein, 10 aa, Artificial Sequence
  Description of Artificial Sequence: Synthetic peptide
PYYYYYGMDV

SEQ ID NO: 4649 - protein, 10 aa, Artificial Sequence
  Description of Artificial Sequence: Synthetic peptide
IYYYYYGMDV

SEQ ID NO: 4650 - protein, 10 aa, Artificial Sequence
  Description of Artificial Sequence: Synthetic peptide
TYYYYYGMDV

SEQ ID NO: 4651 - protein, 10 aa, Artificial Sequence
  Description of Artificial Sequence: Synthetic peptide
GYYYYYGMDV

SEQ ID NO: 4652 - protein, 10 aa, Artificial Sequence
  Description of Artificial Sequence: Synthetic peptide
VYYYYYGMDV

SEQ ID NO: 4653 - protein, 10 aa, Artificial Sequence
  Description of Artificial Sequence: Synthetic peptide
AYYYYYGMDV

SEQ ID NO: 4654 - protein, 9 aa, Artificial Sequence
  Description of Artificial Sequence: Synthetic peptide
NYYYYGMDV

SEQ ID NO: 4655 - protein, 9 aa, Artificial Sequence
  Description of Artificial Sequence: Synthetic peptide
DYYYYGMDV

SEQ ID NO: 4656 - protein, 9 aa, Artificial Sequence
  Description of Artificial Sequence: Synthetic peptide
HYYYYGMDV

SEQ ID NO: 4657 - protein, 9 aa, Artificial Sequence
  Description of Artificial Sequence: Synthetic peptide
FYYYYGMDV

SEQ ID NO: 4658 - protein, 9 aa, Artificial Sequence
  Description of Artificial Sequence: Synthetic peptide
SYYYYGMDV

SEQ ID NO: 4659 - protein, 9 aa, Artificial Sequence
  Description of Artificial Sequence: Synthetic peptide
RYYYYGMDV

SEQ ID NO: 4660 - protein, 9 aa, Artificial Sequence
  Description of Artificial Sequence: Synthetic peptide
LYYYYGMDV

SEQ ID NO: 4661 - protein, 9 aa, Artificial Sequence
  Description of Artificial Sequence: Synthetic peptide
PYYYYGMDV

SEQ ID NO: 4662 - protein, 9 aa, Artificial Sequence
  Description of Artificial Sequence: Synthetic peptide
IYYYYGMDV

SEQ ID NO: 4663 - protein, 9 aa, Artificial Sequence
  Description of Artificial Sequence: Synthetic peptide
TYYYYGMDV

SEQ ID NO: 4664 - protein, 9 aa, Artificial Sequence
  Description of Artificial Sequence: Synthetic peptide
GYYYYGMDV

SEQ ID NO: 4665 - protein, 9 aa, Artificial Sequence
  Description of Artificial Sequence: Synthetic peptide
VYYYYGMDV

SEQ ID NO: 4666 - protein, 9 aa, Artificial Sequence
  Description of Artificial Sequence: Synthetic peptide
AYYYYGMDV

SEQ ID NO: 4667 - protein, 8 aa, Artificial Sequence
  Description of Artificial Sequence: Synthetic peptide
NYYYGMDV

SEQ ID NO: 4668 - protein, 8 aa, Artificial Sequence
  Description of Artificial Sequence: Synthetic peptide
DYYYGMDV

SEQ ID NO: 4669 - protein, 8 aa, Artificial Sequence
  Description of Artificial Sequence: Synthetic peptide
HYYYGMDV

SEQ ID NO: 4670 - protein, 8 aa, Artificial Sequence
  Description of Artificial Sequence: Synthetic peptide
FYYYGMDV

SEQ ID NO: 4671 - protein, 8 aa, Artificial Sequence
  Description of Artificial Sequence: Synthetic peptide
SYYYGMDV

SEQ ID NO: 4672 - protein, 8 aa, Artificial Sequence
  Description of Artificial Sequence: Synthetic peptide
RYYYGMDV

SEQ ID NO: 4673 - protein, 8 aa, Artificial Sequence
  Description of Artificial Sequence: Synthetic peptide
LYYYGMDV

SEQ ID NO: 4674 - protein, 8 aa, Artificial Sequence
  Description of Artificial Sequence: Synthetic peptide
PYYYGMDV

SEQ ID NO: 4675 - protein, 8 aa, Artificial Sequence
  Description of Artificial Sequence: Synthetic peptide
IYYYGMDV

SEQ ID NO: 4676 - protein, 8 aa, Artificial Sequence
  Description of Artificial Sequence: Synthetic peptide
TYYYGMDV

SEQ ID NO: 4677 - protein, 8 aa, Artificial Sequence
  Description of Artificial Sequence: Synthetic peptide
GYYYGMDV

SEQ ID NO: 4678 - protein, 8 aa, Artificial Sequence
  Description of Artificial Sequence: Synthetic peptide
VYYYGMDV

SEQ ID NO: 4679 - protein, 8 aa, Artificial Sequence
  Description of Artificial Sequence: Synthetic peptide
AYYYGMDV

SEQ ID NO: 4680 - protein, 10 aa, Artificial Sequence
  Description of Artificial Sequence: Synthetic peptide
NYYYYYGMDV

SEQ ID NO: 4681 - protein, 10 aa, Artificial Sequence
  Description of Artificial Sequence: Synthetic peptide
DYYYYYYMDV

SEQ ID NO: 4682 - protein, 9 aa, Artificial Sequence
  Description of Artificial Sequence: Synthetic peptide
YYYYYYMDV

SEQ ID NO: 4683 - protein, 8 aa, Artificial Sequence
  Description of Artificial Sequence: Synthetic peptide
YYYYYMDV

SEQ ID NO: 4684 - protein, 7 aa, Artificial Sequence
  Description of Artificial Sequence: Synthetic peptide
YYYYMDV

SEQ ID NO: 4685 - protein, 6 aa, Artificial Sequence
  Description of Artificial Sequence: Synthetic peptide
YYYMDV

SEQ ID NO: 4686 - protein, 5 aa, Artificial Sequence
  Description of Artificial Sequence: Synthetic peptide
YYMDV

SEQ ID NO: 4687 - protein, 4 aa, Artificial Sequence
  Description of Artificial Sequence: Synthetic peptide
YMDV

SEQ ID NO: 4688 - protein, 10 aa, Artificial Sequence
  Description of Artificial Sequence: Synthetic peptide
YYYYYYYMDV

SEQ ID NO: 4689 - protein, 10 aa, Artificial Sequence
  Description of Artificial Sequence: Synthetic peptide
HYYYYYYMDV

SEQ ID NO: 4690 - protein, 10 aa, Artificial Sequence
  Description of Artificial Sequence: Synthetic peptide
FYYYYYYMDV

SEQ ID NO: 4691 - protein, 10 aa, Artificial Sequence
  Description of Artificial Sequence: Synthetic peptide
SYYYYYYMDV

SEQ ID NO: 4692 - protein, 10 aa, Artificial Sequence
  Description of Artificial Sequence: Synthetic peptide
RYYYYYYMDV

SEQ ID NO: 4693 - protein, 10 aa, Artificial Sequence
  Description of Artificial Sequence: Synthetic peptide
LYYYYYYMDV

SEQ ID NO: 4694 - protein, 10 aa, Artificial Sequence
  Description of Artificial Sequence: Synthetic peptide
PYYYYYYMDV

SEQ ID NO: 4695 - protein, 10 aa, Artificial Sequence
  Description of Artificial Sequence: Synthetic peptide
IYYYYYYMDV

SEQ ID NO: 4696 - protein, 10 aa, Artificial Sequence
  Description of Artificial Sequence: Synthetic peptide
TYYYYYYMDV

SEQ ID NO: 4697 - protein, 10 aa, Artificial Sequence
  Description of Artificial Sequence: Synthetic peptide
GYYYYYYMDV

SEQ ID NO: 4698 - protein, 10 aa, Artificial Sequence
  Description of Artificial Sequence: Synthetic peptide
VYYYYYYMDV

SEQ ID NO: 4699 - protein, 10 aa, Artificial Sequence
  Description of Artificial Sequence: Synthetic peptide
AYYYYYYMDV

SEQ ID NO: 4700 - protein, 9 aa, Artificial Sequence
  Description of Artificial Sequence: Synthetic peptide
NYYYYYMDV

SEQ ID NO: 4701 - protein, 9 aa, Artificial Sequence
  Description of Artificial Sequence: Synthetic peptide
DYYYYYMDV

SEQ ID NO: 4702 - protein, 9 aa, Artificial Sequence
  Description of Artificial Sequence: Synthetic peptide
HYYYYYMDV

SEQ ID NO: 4703 - protein, 9 aa, Artificial Sequence
  Description of Artificial Sequence: Synthetic peptide
FYYYYYMDV

SEQ ID NO: 4704 - protein, 9 aa, Artificial Sequence
  Description of Artificial Sequence: Synthetic peptide
SYYYYYMDV

SEQ ID NO: 4705 - protein, 9 aa, Artificial Sequence
  Description of Artificial Sequence: Synthetic peptide
RYYYYYMDV

SEQ ID NO: 4706 - protein, 9 aa, Artificial Sequence
  Description of Artificial Sequence: Synthetic peptide
LYYYYYMDV

SEQ ID NO: 4707 - protein, 9 aa, Artificial Sequence
  Description of Artificial Sequence: Synthetic peptide
PYYYYYMDV

SEQ ID NO: 4708 - protein, 9 aa, Artificial Sequence
  Description of Artificial Sequence: Synthetic peptide
IYYYYYMDV

SEQ ID NO: 4709 - protein, 9 aa, Artificial Sequence
  Description of Artificial Sequence: Synthetic peptide
TYYYYYMDV

SEQ ID NO: 4710 - protein, 9 aa, Artificial Sequence
  Description of Artificial Sequence: Synthetic peptide
GYYYYYMDV

SEQ ID NO: 4711 - protein, 9 aa, Artificial Sequence
  Description of Artificial Sequence: Synthetic peptide
VYYYYYMDV

SEQ ID NO: 4712 - protein, 9 aa, Artificial Sequence
  Description of Artificial Sequence: Synthetic peptide
AYYYYYMDV

SEQ ID NO: 4713 - protein, 8 aa, Artificial Sequence
  Description of Artificial Sequence: Synthetic peptide
NYYYYMDV

SEQ ID NO: 4714 - protein, 8 aa, Artificial Sequence
  Description of Artificial Sequence: Synthetic peptide
DYYYYMDV

SEQ ID NO: 4715 - protein, 8 aa, Artificial Sequence
  Description of Artificial Sequence: Synthetic peptide
HYYYYMDV

SEQ ID NO: 4716 - protein, 8 aa, Artificial Sequence
  Description of Artificial Sequence: Synthetic peptide
FYYYYMDV

SEQ ID NO: 4717 - protein, 8 aa, Artificial Sequence
  Description of Artificial Sequence: Synthetic peptide
SYYYYMDV

SEQ ID NO: 4718 - protein, 8 aa, Artificial Sequence
  Description of Artificial Sequence: Synthetic peptide
RYYYYMDV

SEQ ID NO: 4719 - protein, 8 aa, Artificial Sequence
  Description of Artificial Sequence: Synthetic peptide
LYYYYMDV

SEQ ID NO: 4720 - protein, 8 aa, Artificial Sequence
  Description of Artificial Sequence: Synthetic peptide
PYYYYMDV

SEQ ID NO: 4721 - protein, 8 aa, Artificial Sequence
  Description of Artificial Sequence: Synthetic peptide
IYYYYMDV

SEQ ID NO: 4722 - protein, 8 aa, Artificial Sequence
  Description of Artificial Sequence: Synthetic peptide
TYYYYMDV

SEQ ID NO: 4723 - protein, 8 aa, Artificial Sequence
  Description of Artificial Sequence: Synthetic peptide
GYYYYMDV

SEQ ID NO: 4724 - protein, 8 aa, Artificial Sequence
  Description of Artificial Sequence: Synthetic peptide
VYYYYMDV

SEQ ID NO: 4725 - protein, 8 aa, Artificial Sequence
  Description of Artificial Sequence: Synthetic peptide
AYYYYMDV

SEQ ID NO: 4726 - protein, 10 aa, Artificial Sequence
  Description of Artificial Sequence: Synthetic peptide
NYYYYYYMDV

SEQ ID NO: 4727 - DNA, 52 bp, Homo sapiens
gctgaatacttccagcactggggccagggcaccctggtcaccgtctcctcag

SEQ ID NO: 4728 - DNA, 53 bp, Homo sapiens
ctactggtacttcgatctctggggccgtggcaccctggtcactgtctcctcag

SEQ ID NO: 4729 - DNA, 48 bp, Homo sapiens
atgcttttgatgtctggggccaagggacaatggtcaccgtctcttcag

SEQ ID NO: 4730 - DNA, 48 bp, Homo sapiens
atgcttttgatatctggggccaagggacaatggtcaccgtctcttcag

SEQ ID NO: 4731 - DNA, 48 bp, Homo sapiens
actactttgactactggggccaaggaaccctggtcaccgtctcctcag

SEQ ID NO: 4732 - DNA, 48 bp, Homo sapiens
actactttgactactggggccagggaaccctggtcaccgtctcctcag

SEQ ID NO: 4733 - DNA, 48 bp, Homo sapiens
gctactttgactactggggccaagggaccctggtcaccgtctcctcag

SEQ ID NO: 4734 - DNA, 51 bp, Homo sapiens
acaactggttcgactcctggggccaaggaaccctggtcaccgtctcctcag

SEQ ID NO: 4735 - DNA, 51 bp, Homo sapiens
acaactggttcgacccctggggccagggaaccctggtcaccgtctcctcag

SEQ ID NO: 4736 - DNA, 63 bp, Homo sapiens
attactactactactacggtatggacgtctgggggcaagggaccacggtcaccgtctcctcag

SEQ ID NO: 4737 - DNA, 63 bp, Homo sapiens
attactactactactacggtatggacgtctggggccaagggaccacggtcaccgtctcctcag

SEQ ID NO: 4738 - DNA, 63 bp, Homo sapiens
attactactactactactacatggacgtctggggcaaagggaccacggtcaccgtctcctcag

SEQ ID NO: 4739 - DNA, 17 bp, Homo sapiens
ggtacaactggaacgac

SEQ ID NO: 4740 - DNA, 17 bp, Homo sapiens
ggtataactggaacgac

SEQ ID NO: 4741 - DNA, 20 bp, Homo sapiens
ggtatagtgggagctactac

SEQ ID NO: 4742 - DNA, 17 bp, Homo sapiens
ggtataactggaactac

SEQ ID NO: 4743 - DNA, 31 bp, Homo sapiens
aggatattgtagtggtggtagctgctactcc

SEQ ID NO: 4744 - DNA, 31 bp, Homo sapiens
aggatattgtagtagtaccagctgctatgcc

SEQ ID NO: 4745 - DNA, 31 bp, Homo sapiens
aggatattgtagtagtaccagctgctatacc

SEQ ID NO: 4746 - DNA, 31 bp, Homo sapiens
tggatattgtagtagtaccagctgctatgcc

SEQ ID NO: 4747 - DNA, 28 bp, Homo sapiens
agcatattgtggtggtgattgctattcc

SEQ ID NO: 4748 - DNA, 28 bp, Homo sapiens
agcatattgtggtggtgactgctattcc

SEQ ID NO: 4749 - DNA, 31 bp, Homo sapiens
aggatattgtactaatggtgtatgctatacc

SEQ ID NO: 4750 - DNA, 31 bp, Homo sapiens
gtattactatggttcggggagttattataac

SEQ ID NO: 4751 - DNA, 31 bp, Homo sapiens
gtattactatggttcagggagttattataac

SEQ ID NO: 4752 - DNA, 37 bp, Homo sapiens
gtattatgattacgtttgggggagttatgcttatacc

SEQ ID NO: 4753 - DNA, 31 bp, Homo sapiens
gtattactatgatagtagtggttattactac

SEQ ID NO: 4754 - DNA, 31 bp, Homo sapiens
gtattacgatttttggagtggttattatacc

SEQ ID NO: 4755 - DNA, 31 bp, Homo sapiens
gtattacgatattttgactggttattataac

SEQ ID NO: 4756 - DNA, 16 bp, Homo sapiens
tgactacggtgactac

SEQ ID NO: 4757 - DNA, 19 bp, Homo sapiens
tgactacggtggtaactcc

SEQ ID NO: 4758 - DNA, 16 bp, Homo sapiens
tgactacagtaactac

SEQ ID NO: 4759 - DNA, 23 bp, Homo sapiens
gtggatatagtggctacgattac

SEQ ID NO: 4760 - DNA, 20 bp, Homo sapiens
gtagagatggctacaattac

SEQ ID NO: 4761 - DNA, 20 bp, Homo sapiens
gtggatacagctatggttac

SEQ ID NO: 4762 - DNA, 21 bp, Homo sapiens
gggtatagcagcagctggtac

SEQ ID NO: 4763 - DNA, 21 bp, Homo sapiens
gggtatagcagtggctggtac

SEQ ID NO: 4764 - DNA, 18 bp, Homo sapiens
gagtatagcagctcgtcc

SEQ ID NO: 4765 - DNA, 11 bp, Homo sapiens
ctaactgggga

SEQ ID NO: 4766 - protein, 5 aa, Artificial Sequence
  chemically synthesized polypeptide
VZLEL

SEQ ID NO: 4767 - protein, 5 aa, Artificial Sequence
  chemically synthesized polypeptide
VZLER

SEQ ID NO: 4768 - protein, 5 aa, Artificial Sequence
  chemically synthesized polypeptide
VZQLV

SEQ ID NO: 4769 - protein, 5 aa, Artificial Sequence
  chemically synthesized oligonucleotide
ZLQZL

SEQ ID NO: 4770 - protein, 5 aa, Artificial Sequence
  chemically synthesized polypeptide
ZLRZL

SEQ ID NO: 4771 - protein, 4 aa, Artificial Sequence
  Description of Artificial Sequence: Synthetic peptide
QQLV

SEQ ID NO: 4772 - protein, 4 aa, Artificial Sequence
  Description of Artificial Sequence: Synthetic peptide
QWLV

SEQ ID NO: 4773 - protein, 4 aa, Artificial Sequence
  Description of Artificial Sequence: Synthetic peptide
WELL

SEQ ID NO: 4774 - protein, 6 aa, Artificial Sequence
  chemically synthesized polypeptide
ZLRWZL

SEQ ID NO: 4775 - protein, 5 aa, Artificial Sequence
  Description of Artificial Sequence: Synthetic peptide
RWLQL

SEQ ID NO: 4776 - protein, 4 aa, Artificial Sequence
  Description of Artificial Sequence: Synthetic peptide
WLRL

SEQ ID NO: 4777 - protein, 9 aa, Artificial Sequence
  Description of Artificial Sequence: Synthetic peptide
SILWWZLLF

SEQ ID NO: 4778 - protein, 4 aa, Artificial Sequence
  Description of Artificial Sequence: Synthetic peptide
ITIF

SEQ ID NO: 4779 - protein, 4 aa, Artificial Sequence
  Description of Artificial Sequence: Synthetic peptide
RILY

SEQ ID NO: 4780 - protein, 5 aa, Artificial Sequence
  chemically synthesized polypeptide
WZLLL

SEQ ID NO: 4781 - protein, 5 aa, Artificial Sequence
  Description of Artificial Sequence: Synthetic peptide
YQLLC

SEQ ID NO: 4782 - protein, 5 aa, Artificial Sequence
  Description of Artificial Sequence: Synthetic peptide
YQLLY

SEQ ID NO: 4783 - protein, 9 aa, Artificial Sequence
  Description of Artificial Sequence: Synthetic peptide
VLLWFGELL

SEQ ID NO: 4784 - protein, 9 aa, Artificial Sequence
  Description of Artificial Sequence: Synthetic peptide
VLLWFRELL

SEQ ID NO: 4785 - protein, 4 aa, Artificial Sequence
  Description of Artificial Sequence: Synthetic peptide
WLLL

SEQ ID NO: 4786 - protein, 9 aa, Artificial Sequence
  Description of Artificial Sequence: Synthetic peptide
VLRYFDWLL

SEQ ID NO: 4787 - protein, 5 aa, Artificial Sequence
  Description of Artificial Sequence: Synthetic peptide
YQLLC

SEQ ID NO: 4788 - protein, 9 aa, Artificial Sequence
  Description of Artificial Sequence: Synthetic peptide
LRLGELCLY

SEQ ID NO: 4789 - protein, 4 aa, Artificial Sequence
  Description of Artificial Sequence: Synthetic peptide
GRRG

SEQ ID NO: 4790 - protein, 4 aa, Artificial Sequence
  Description of Artificial Sequence: Synthetic peptide
DQGG

SEQ ID NO: 4791 - protein, 4 aa, Artificial Sequence
  Description of Artificial Sequence: Synthetic peptide
AREG

SEQ ID NO: 4792 - protein, 4 aa, Artificial Sequence
  Description of Artificial Sequence: Synthetic peptide
ARDG

SEQ ID NO: 4793 - protein, 4 aa, Artificial Sequence
  Description of Artificial Sequence: Synthetic peptide
ARGG

SEQ ID NO: 4794 - protein, 4 aa, Artificial Sequence
  Description of Artificial Sequence: Synthetic peptide
ARER

SEQ ID NO: 4795 - protein, 4 aa, Artificial Sequence
  Description of Artificial Sequence: Synthetic peptide
ARDR

SEQ ID NO: 4796 - protein, 4 aa, Artificial Sequence
  Description of Artificial Sequence: Synthetic peptide
ARGR

SEQ ID NO: 4797 - protein, 4 aa, Artificial Sequence
  Description of Artificial Sequence: Synthetic peptide
ARES

SEQ ID NO: 4798 - protein, 4 aa, Artificial Sequence
  Description of Artificial Sequence: Synthetic peptide
ARDS

SEQ ID NO: 4799 - protein, 4 aa, Artificial Sequence
  Description of Artificial Sequence: Synthetic peptide
ARGS

SEQ ID NO: 4800 - protein, 4 aa, Artificial Sequence
  Description of Artificial Sequence: Synthetic peptide
ARDP

SEQ ID NO: 4801 - protein, 4 aa, Artificial Sequence
  Description of Artificial Sequence: Synthetic peptide
ARGP

SEQ ID NO: 4802 - protein, 4 aa, Artificial Sequence
  Description of Artificial Sequence: Synthetic peptide
ARDL

SEQ ID NO: 4803 - protein, 4 aa, Artificial Sequence
  Description of Artificial Sequence: Synthetic peptide
ARGL

SEQ ID NO: 4804 - protein, 4 aa, Artificial Sequence
  Description of Artificial Sequence: Synthetic peptide
AREA

SEQ ID NO: 4805 - protein, 4 aa, Artificial Sequence
  Description of Artificial Sequence: Synthetic peptide
ARDA

SEQ ID NO: 4806 - protein, 4 aa, Artificial Sequence
  Description of Artificial Sequence: Synthetic peptide
ARGA

SEQ ID NO: 4807 - protein, 4 aa, Artificial Sequence
  Description of Artificial Sequence: Synthetic peptide
ARET

SEQ ID NO: 4808 - protein, 4 aa, Artificial Sequence
  Description of Artificial Sequence: Synthetic peptide
ARDT

SEQ ID NO: 4809 - protein, 4 aa, Artificial Sequence
  Description of Artificial Sequence: Synthetic peptide
ARGT

SEQ ID NO: 4810 - protein, 4 aa, Artificial Sequence
  Description of Artificial Sequence: Synthetic peptide
AREV

SEQ ID NO: 4811 - protein, 4 aa, Artificial Sequence
  Description of Artificial Sequence: Synthetic peptide
ARDV

SEQ ID NO: 4812 - protein, 4 aa, Artificial Sequence
  Description of Artificial Sequence: Synthetic peptide
ARGV

SEQ ID NO: 4813 - protein, 5 aa, Artificial Sequence
  Description of Artificial Sequence: Synthetic peptide
AREGG

SEQ ID NO: 4814 - protein, 5 aa, Artificial Sequence
  Description of Artificial Sequence: Synthetic peptide
ARDGG

SEQ ID NO: 4815 - protein, 5 aa, Artificial Sequence
  Description of Artificial Sequence: Synthetic peptide
ARGGG

SEQ ID NO: 4816 - protein, 5 aa, Artificial Sequence
  Description of Artificial Sequence: Synthetic peptide
ARDGR

SEQ ID NO: 4817 - protein, 5 aa, Artificial Sequence
  Description of Artificial Sequence: Synthetic peptide
ARGGS

SEQ ID NO: 4818 - protein, 5 aa, Artificial Sequence
  Description of Artificial Sequence: Synthetic peptide
ARGGP

SEQ ID NO: 4819 - protein, 5 aa, Artificial Sequence
  Description of Artificial Sequence: Synthetic peptide
ARGGA

SEQ ID NO: 4820 - protein, 5 aa, Artificial Sequence
  Description of Artificial Sequence: Synthetic peptide
ARDGT

SEQ ID NO: 4821 - protein, 5 aa, Artificial Sequence
  Description of Artificial Sequence: Synthetic peptide
ARGGT

SEQ ID NO: 4822 - protein, 5 aa, Artificial Sequence
  Description of Artificial Sequence: Synthetic peptide
AREGV

SEQ ID NO: 4823 - protein, 5 aa, Artificial Sequence
  Description of Artificial Sequence: Synthetic peptide
ARGGV

SEQ ID NO: 4824 - protein, 4 aa, Artificial Sequence
  Description of Artificial Sequence: Synthetic peptide
ARRG

SEQ ID NO: 4825 - protein, 5 aa, Artificial Sequence
  Description of Artificial Sequence: Synthetic peptide
ARERG

SEQ ID NO: 4826 - protein, 5 aa, Artificial Sequence
  Description of Artificial Sequence: Synthetic peptide
ARDRG

SEQ ID NO: 4827 - protein, 5 aa, Artificial Sequence
  Description of Artificial Sequence: Synthetic peptide
ARGRG

SEQ ID NO: 4828 - protein, 4 aa, Artificial Sequence
  Description of Artificial Sequence: Synthetic peptide
ARSG

SEQ ID NO: 4829 - protein, 5 aa, Artificial Sequence
  Description of Artificial Sequence: Synthetic peptide
ARDSG

SEQ ID NO: 4830 - protein, 5 aa, Artificial Sequence
  Description of Artificial Sequence: Synthetic peptide
ARDPG

SEQ ID NO: 4831 - protein, 4 aa, Artificial Sequence
  Description of Artificial Sequence: Synthetic peptide
ARLG

SEQ ID NO: 4832 - protein, 5 aa, Artificial Sequence
  Description of Artificial Sequence: Synthetic peptide
ARDLG

SEQ ID NO: 4833 - protein, 4 aa, Artificial Sequence
  Description of Artificial Sequence: Synthetic peptide
ARAG

SEQ ID NO: 4834 - protein, 4 aa, Artificial Sequence
  Description of Artificial Sequence: Synthetic peptide
ARVG

SEQ ID NO: 4835 - protein, 5 aa, Artificial Sequence
  Description of Artificial Sequence: Synthetic peptide
ARGVG

SEQ ID NO: 4836 - protein, 4 aa, Artificial Sequence
  Description of Artificial Sequence: Synthetic peptide
ARPR

SEQ ID NO: 4837 - protein, 5 aa, Artificial Sequence
  Description of Artificial Sequence: Synthetic peptide
ARGPR

SEQ ID NO: 4838 - protein, 4 aa, Artificial Sequence
  Description of Artificial Sequence: Synthetic peptide
ARPS

SEQ ID NO: 4839 - protein, 5 aa, Artificial Sequence
  Description of Artificial Sequence: Synthetic peptide
ARDPS

SEQ ID NO: 4840 - protein, 5 aa, Artificial Sequence
  Description of Artificial Sequence: Synthetic peptide
ARGPS

SEQ ID NO: 4841 - protein, 5 aa, Artificial Sequence
  Description of Artificial Sequence: Synthetic peptide
ARDPP

SEQ ID NO: 4842 - protein, 5 aa, Artificial Sequence
  Description of Artificial Sequence: Synthetic peptide
ARGPP

SEQ ID NO: 4843 - protein, 4 aa, Artificial Sequence
  Description of Artificial Sequence: Synthetic peptide
ARPL

SEQ ID NO: 4844 - protein, 5 aa, Artificial Sequence
  Description of Artificial Sequence: Synthetic peptide
ARDPL

SEQ ID NO: 4845 - protein, 4 aa, Artificial Sequence
  Description of Artificial Sequence: Synthetic peptide
ARRP

SEQ ID NO: 4846 - protein, 5 aa, Artificial Sequence
  Description of Artificial Sequence: Synthetic peptide
ARDRP

SEQ ID NO: 4847 - protein, 4 aa, Artificial Sequence
  Description of Artificial Sequence: Synthetic peptide
ARSP

SEQ ID NO: 4848 - protein, 4 aa, Artificial Sequence
  Description of Artificial Sequence: Synthetic peptide
ARLP

SEQ ID NO: 4849 - protein, 4 aa, Artificial Sequence
  Description of Artificial Sequence: Synthetic peptide
ARAP

SEQ ID NO: 4850 - protein, 4 aa, Artificial Sequence
  Description of Artificial Sequence: Synthetic peptide
ARTP

SEQ ID NO: 4851 - protein, 4 aa, Artificial Sequence
  Description of Artificial Sequence: Synthetic peptide
ARVP

SEQ ID NO: 4852 - protein, 5 aa, Artificial Sequence
  Description of Artificial Sequence: Synthetic peptide
ARVGG

SEQ ID NO: 4853 - protein, 4 aa, Artificial Sequence
  Description of Artificial Sequence: Synthetic peptide
ARDQ

SEQ ID NO: 4854 - protein, 4 aa, Artificial Sequence
  Description of Artificial Sequence: Synthetic peptide
ARDH

SEQ ID NO: 4855 - protein, 4 aa, Artificial Sequence
  Description of Artificial Sequence: Synthetic peptide
ARAR

SEQ ID NO: 4856 - protein, 4 aa, Artificial Sequence
  Description of Artificial Sequence: Synthetic peptide
ARAS

SEQ ID NO: 4857 - protein, 5 aa, Artificial Sequence
  Description of Artificial Sequence: Synthetic peptide
ARDQG

SEQ ID NO: 4858 - protein, 4 aa, Artificial Sequence
  Description of Artificial Sequence: Synthetic peptide
ARSR

SEQ ID NO: 4859 - protein, 5 aa, Artificial Sequence
  Description of Artificial Sequence: Synthetic peptide
ARDRS

SEQ ID NO: 4860 - protein, 4 aa, Artificial Sequence
  Description of Artificial Sequence: Synthetic peptide
ARSL

SEQ ID NO: 4861 - protein, 4 aa, Artificial Sequence
  Description of Artificial Sequence: Synthetic peptide
ARLH

SEQ ID NO: 4862 - protein, 5 aa, Artificial Sequence
  Description of Artificial Sequence: Synthetic peptide
ARDLT

SEQ ID NO: 4863 - protein, 4 aa, Artificial Sequence
  Description of Artificial Sequence: Synthetic peptide
ARAE

SEQ ID NO: 4864 - protein, 5 aa, Artificial Sequence
  Description of Artificial Sequence: Synthetic peptide
ARDLS

SEQ ID NO: 4865 - protein, 4 aa, Artificial Sequence
  Description of Artificial Sequence: Synthetic peptide
ARGD

SEQ ID NO: 4866 - protein, 4 aa, Artificial Sequence
  Description of Artificial Sequence: Synthetic peptide
ARRR

SEQ ID NO: 4867 - protein, 4 aa, Artificial Sequence
  Description of Artificial Sequence: Synthetic peptide
ARDK

SEQ ID NO: 4868 - protein, 4 aa, Artificial Sequence
  Description of Artificial Sequence: Synthetic peptide
ARVS

SEQ ID NO: 4869 - protein, 5 aa, Artificial Sequence
  Description of Artificial Sequence: Synthetic peptide
ARDRL

SEQ ID NO: 4870 - protein, 4 aa, Artificial Sequence
  Description of Artificial Sequence: Synthetic peptide
ARGQ

SEQ ID NO: 4871 - protein, 4 aa, Artificial Sequence
  Description of Artificial Sequence: Synthetic peptide
ARVR

SEQ ID NO: 4872 - protein, 4 aa, Artificial Sequence
  Description of Artificial Sequence: Synthetic peptide
ARAK

SEQ ID NO: 4873 - protein, 4 aa, Artificial Sequence
  Description of Artificial Sequence: Synthetic peptide
ARGK

SEQ ID NO: 4874 - protein, 5 aa, Artificial Sequence
  Description of Artificial Sequence: Synthetic peptide
ARDIS

SEQ ID NO: 4875 - protein, 5 aa, Artificial Sequence
  Description of Artificial Sequence: Synthetic peptide
ARDFT

SEQ ID NO: 4876 - protein, 4 aa, Artificial Sequence
  Description of Artificial Sequence: Synthetic peptide
ARQG

SEQ ID NO: 4877 - protein, 4 aa, Artificial Sequence
  Description of Artificial Sequence: Synthetic peptide
AKEG

SEQ ID NO: 4878 - protein, 4 aa, Artificial Sequence
  Description of Artificial Sequence: Synthetic peptide
AKDG

SEQ ID NO: 4879 - protein, 4 aa, Artificial Sequence
  Description of Artificial Sequence: Synthetic peptide
AKGG

SEQ ID NO: 4880 - protein, 4 aa, Artificial Sequence
  Description of Artificial Sequence: Synthetic peptide
AKER

SEQ ID NO: 4881 - protein, 4 aa, Artificial Sequence
  Description of Artificial Sequence: Synthetic peptide
AKDR

SEQ ID NO: 4882 - protein, 4 aa, Artificial Sequence
  Description of Artificial Sequence: Synthetic peptide
AKGR

SEQ ID NO: 4883 - protein, 4 aa, Artificial Sequence
  Description of Artificial Sequence: Synthetic peptide
AKES

SEQ ID NO: 4884 - protein, 4 aa, Artificial Sequence
  Description of Artificial Sequence: Synthetic peptide
AKDS

SEQ ID NO: 4885 - protein, 4 aa, Artificial Sequence
  Description of Artificial Sequence: Synthetic peptide
AKGS

SEQ ID NO: 4886 - protein, 4 aa, Artificial Sequence
  Description of Artificial Sequence: Synthetic peptide
AKDP

SEQ ID NO: 4887 - protein, 4 aa, Artificial Sequence
  Description of Artificial Sequence: Synthetic peptide
AKGP

SEQ ID NO: 4888 - protein, 4 aa, Artificial Sequence
  Description of Artificial Sequence: Synthetic peptide
AKDL

SEQ ID NO: 4889 - protein, 4 aa, Artificial Sequence
  Description of Artificial Sequence: Synthetic peptide
AKGL

SEQ ID NO: 4890 - protein, 4 aa, Artificial Sequence
  Description of Artificial Sequence: Synthetic peptide
AKEA

SEQ ID NO: 4891 - protein, 4 aa, Artificial Sequence
  Description of Artificial Sequence: Synthetic peptide
AKDA

SEQ ID NO: 4892 - protein, 4 aa, Artificial Sequence
  Description of Artificial Sequence: Synthetic peptide
AKGA

SEQ ID NO: 4893 - protein, 4 aa, Artificial Sequence
  Description of Artificial Sequence: Synthetic peptide
AKET

SEQ ID NO: 4894 - protein, 4 aa, Artificial Sequence
  Description of Artificial Sequence: Synthetic peptide
AKDT

SEQ ID NO: 4895 - protein, 4 aa, Artificial Sequence
  Description of Artificial Sequence: Synthetic peptide
AKGT

SEQ ID NO: 4896 - protein, 4 aa, Artificial Sequence
  Description of Artificial Sequence: Synthetic peptide
AKEV

SEQ ID NO: 4897 - protein, 4 aa, Artificial Sequence
  Description of Artificial Sequence: Synthetic peptide
AKDV

SEQ ID NO: 4898 - protein, 4 aa, Artificial Sequence
  Description of Artificial Sequence: Synthetic peptide
AKGV

SEQ ID NO: 4899 - protein, 5 aa, Artificial Sequence
  Description of Artificial Sequence: Synthetic peptide
AKEGG

SEQ ID NO: 4900 - protein, 5 aa, Artificial Sequence
  Description of Artificial Sequence: Synthetic peptide
AKDGG

SEQ ID NO: 4901 - protein, 5 aa, Artificial Sequence
  Description of Artificial Sequence: Synthetic peptide
AKGGG

SEQ ID NO: 4902 - protein, 5 aa, Artificial Sequence
  Description of Artificial Sequence: Synthetic peptide
AKDGR

SEQ ID NO: 4903 - protein, 5 aa, Artificial Sequence
  Description of Artificial Sequence: Synthetic peptide
AKGGS

SEQ ID NO: 4904 - protein, 5 aa, Artificial Sequence
  Description of Artificial Sequence: Synthetic peptide
AKGGP

SEQ ID NO: 4905 - protein, 5 aa, Artificial Sequence
  Description of Artificial Sequence: Synthetic peptide
AKGGA

SEQ ID NO: 4906 - protein, 5 aa, Artificial Sequence
  Description of Artificial Sequence: Synthetic peptide
AKDGT

SEQ ID NO: 4907 - protein, 5 aa, Artificial Sequence
  Description of Artificial Sequence: Synthetic peptide
AKGGT

SEQ ID NO: 4908 - protein, 5 aa, Artificial Sequence
  Description of Artificial Sequence: Synthetic peptide
AKEGV

SEQ ID NO: 4909 - protein, 5 aa, Artificial Sequence
  Description of Artificial Sequence: Synthetic peptide
AKGGV

SEQ ID NO: 4910 - protein, 4 aa, Artificial Sequence
  Description of Artificial Sequence: Synthetic peptide
AKRG

SEQ ID NO: 4911 - protein, 5 aa, Artificial Sequence
  Description of Artificial Sequence: Synthetic peptide
AKERG

SEQ ID NO: 4912 - protein, 5 aa, Artificial Sequence
  Description of Artificial Sequence: Synthetic peptide
AKDRG

SEQ ID NO: 4913 - protein, 5 aa, Artificial Sequence
  Description of Artificial Sequence: Synthetic peptide
AKGRG

SEQ ID NO: 4914 - protein, 4 aa, Artificial Sequence
  Description of Artificial Sequence: Synthetic peptide
AKSG

SEQ ID NO: 4915 - protein, 5 aa, Artificial Sequence
  Description of Artificial Sequence: Synthetic peptide
AKDSG

SEQ ID NO: 4916 - protein, 5 aa, Artificial Sequence
  Description of Artificial Sequence: Synthetic peptide
AKDPG

SEQ ID NO: 4917 - protein, 4 aa, Artificial Sequence
  Description of Artificial Sequence: Synthetic peptide
AKLG

SEQ ID NO: 4918 - protein, 5 aa, Artificial Sequence
  Description of Artificial Sequence: Synthetic peptide
AKDLG

SEQ ID NO: 4919 - protein, 4 aa, Artificial Sequence
  Description of Artificial Sequence: Synthetic peptide
AKAG

SEQ ID NO: 4920 - protein, 4 aa, Artificial Sequence
  Description of Artificial Sequence: Synthetic peptide
AKVG

SEQ ID NO: 4921 - protein, 5 aa, Artificial Sequence
  Description of Artificial Sequence: Synthetic peptide
AKGVG

SEQ ID NO: 4922 - protein, 4 aa, Artificial Sequence
  Description of Artificial Sequence: Synthetic peptide
AKPR

SEQ ID NO: 4923 - protein, 5 aa, Artificial Sequence
  Description of Artificial Sequence: Synthetic peptide
AKGPR

SEQ ID NO: 4924 - protein, 4 aa, Artificial Sequence
  Description of Artificial Sequence: Synthetic peptide
AKPS

SEQ ID NO: 4925 - protein, 5 aa, Artificial Sequence
  Description of Artificial Sequence: Synthetic peptide
AKDPS

SEQ ID NO: 4926 - protein, 5 aa, Artificial Sequence
  Description of Artificial Sequence: Synthetic peptide
AKGPS

SEQ ID NO: 4927 - protein, 5 aa, Artificial Sequence
  Description of Artificial Sequence: Synthetic peptide
AKDPP

SEQ ID NO: 4928 - protein, 5 aa, Artificial Sequence
  Description of Artificial Sequence: Synthetic peptide
AKGPP

SEQ ID NO: 4929 - protein, 4 aa, Artificial Sequence
  Description of Artificial Sequence: Synthetic peptide
AKPL

SEQ ID NO: 4930 - protein, 5 aa, Artificial Sequence
  Description of Artificial Sequence: Synthetic peptide
AKDPL

SEQ ID NO: 4931 - protein, 4 aa, Artificial Sequence
  Description of Artificial Sequence: Synthetic peptide
AKRP

SEQ ID NO: 4932 - protein, 5 aa, Artificial Sequence
  Description of Artificial Sequence: Synthetic peptide
AKDRP

SEQ ID NO: 4933 - protein, 4 aa, Artificial Sequence
  Description of Artificial Sequence: Synthetic peptide
AKSP

SEQ ID NO: 4934 - protein, 4 aa, Artificial Sequence
  Description of Artificial Sequence: Synthetic peptide
AKLP

SEQ ID NO: 4935 - protein, 4 aa, Artificial Sequence
  Description of Artificial Sequence: Synthetic peptide
AKAP

SEQ ID NO: 4936 - protein, 4 aa, Artificial Sequence
  Description of Artificial Sequence: Synthetic peptide
AKTP

SEQ ID NO: 4937 - protein, 4 aa, Artificial Sequence
  Description of Artificial Sequence: Synthetic peptide
AKVP

SEQ ID NO: 4938 - protein, 5 aa, Artificial Sequence
  Description of Artificial Sequence: Synthetic peptide
AKVGG

SEQ ID NO: 4939 - protein, 4 aa, Artificial Sequence
  Description of Artificial Sequence: Synthetic peptide
AKDQ

SEQ ID NO: 4940 - protein, 4 aa, Artificial Sequence
  Description of Artificial Sequence: Synthetic peptide
AKDH

SEQ ID NO: 4941 - protein, 4 aa, Artificial Sequence
  Description of Artificial Sequence: Synthetic peptide
AKAR

SEQ ID NO: 4942 - protein, 4 aa, Artificial Sequence
  Description of Artificial Sequence: Synthetic peptide
AKAS

SEQ ID NO: 4943 - protein, 5 aa, Artificial Sequence
  Description of Artificial Sequence: Synthetic peptide
AKDQG

SEQ ID NO: 4944 - protein, 4 aa, Artificial Sequence
  Description of Artificial Sequence: Synthetic peptide
AKSR

SEQ ID NO: 4945 - protein, 5 aa, Artificial Sequence
  Description of Artificial Sequence: Synthetic peptide
AKDRS

SEQ ID NO: 4946 - protein, 4 aa, Artificial Sequence
  Description of Artificial Sequence: Synthetic peptide
AKSL

SEQ ID NO: 4947 - protein, 4 aa, Artificial Sequence
  Description of Artificial Sequence: Synthetic peptide
AKLH

SEQ ID NO: 4948 - protein, 5 aa, Artificial Sequence
  Description of Artificial Sequence: Synthetic peptide
AKDLT

SEQ ID NO: 4949 - protein, 4 aa, Artificial Sequence
  Description of Artificial Sequence: Synthetic peptide
AKAE

SEQ ID NO: 4950 - protein, 5 aa, Artificial Sequence
  Description of Artificial Sequence: Synthetic peptide
AKDLS

SEQ ID NO: 4951 - protein, 4 aa, Artificial Sequence
  Description of Artificial Sequence: Synthetic peptide
AKGD

SEQ ID NO: 4952 - protein, 4 aa, Artificial Sequence
  Description of Artificial Sequence: Synthetic peptide
AKRR

SEQ ID NO: 4953 - protein, 4 aa, Artificial Sequence
  Description of Artificial Sequence: Synthetic peptide
AKDK

SEQ ID NO: 4954 - protein, 4 aa, Artificial Sequence
  Description of Artificial Sequence: Synthetic peptide
AKVS

SEQ ID NO: 4955 - protein, 5 aa, Artificial Sequence
  Description of Artificial Sequence: Synthetic peptide
AKDRL

SEQ ID NO: 4956 - protein, 4 aa, Artificial Sequence
  Description of Artificial Sequence: Synthetic peptide
AKGQ

SEQ ID NO: 4957 - protein, 4 aa, Artificial Sequence
  Description of Artificial Sequence: Synthetic peptide
AKVR

SEQ ID NO: 4958 - protein, 4 aa, Artificial Sequence
  Description of Artificial Sequence: Synthetic peptide
AKAK

SEQ ID NO: 4959 - protein, 4 aa, Artificial Sequence
  Description of Artificial Sequence: Synthetic peptide
AKGK

SEQ ID NO: 4960 - protein, 5 aa, Artificial Sequence
  Description of Artificial Sequence: Synthetic peptide
AKDIS

SEQ ID NO: 4961 - protein, 5 aa, Artificial Sequence
  Description of Artificial Sequence: Synthetic peptide
AKDFT

SEQ ID NO: 4962 - protein, 4 aa, Artificial Sequence
  Description of Artificial Sequence: Synthetic peptide
AKQG

SEQ ID NO: 4963 - DNA, 12 bp, Artificial Sequence
  Description of Artificial Sequence: Synthetic oligonucleotide
gccagagaggga

SEQ ID NO: 4964 - DNA, 12 bp, Artificial Sequence
  Description of Artificial Sequence: Synthetic oligonucleotide
gccagagacgga

SEQ ID NO: 4965 - DNA, 12 bp, Artificial Sequence
  Description of Artificial Sequence: Synthetic oligonucleotide
gccagaggtgga

SEQ ID NO: 4966 - DNA, 12 bp, Artificial Sequence
  Description of Artificial Sequence: Synthetic oligonucleotide
gccagagagaga

SEQ ID NO: 4967 - DNA, 12 bp, Artificial Sequence
  Description of Artificial Sequence: Synthetic oligonucleotide
gccagagacaga

SEQ ID NO: 4968 - DNA, 12 bp, Artificial Sequence
  Description of Artificial Sequence: Synthetic oligonucleotide
gccagaggcaga

SEQ ID NO: 4969 - DNA, 12 bp, Artificial Sequence
  Description of Artificial Sequence: Synthetic oligonucleotide
gccagagaatct

SEQ ID NO: 4970 - DNA, 12 bp, Artificial Sequence
  Description of Artificial Sequence: Synthetic oligonucleotide
gccagagactct

SEQ ID NO: 4971 - DNA, 12 bp, Artificial Sequence
  Description of Artificial Sequence: Synthetic oligonucleotide
gccagaggttct

SEQ ID NO: 4972 - DNA, 12 bp, Artificial Sequence
  Description of Artificial Sequence: Synthetic oligonucleotide
gccagagaccct

SEQ ID NO: 4973 - DNA, 12 bp, Artificial Sequence
  Description of Artificial Sequence: Synthetic oligonucleotide
gccagagggcct

SEQ ID NO: 4974 - DNA, 12 bp, Artificial Sequence
  Description of Artificial Sequence: Synthetic oligonucleotide
gccagagacttg

SEQ ID NO: 4975 - DNA, 12 bp, Artificial Sequence
  Description of Artificial Sequence: Synthetic oligonucleotide
gccagagggttg

SEQ ID NO: 4976 - DNA, 12 bp, Artificial Sequence
  Description of Artificial Sequence: Synthetic oligonucleotide
gccagagaggct

SEQ ID NO: 4977 - DNA, 12 bp, Artificial Sequence
  Description of Artificial Sequence: Synthetic oligonucleotide
gccagagatgct

SEQ ID NO: 4978 - DNA, 12 bp, Artificial Sequence
  Description of Artificial Sequence: Synthetic oligonucleotide
gccagaggtgct

SEQ ID NO: 4979 - DNA, 12 bp, Artificial Sequence
  Description of Artificial Sequence: Synthetic oligonucleotide
gccagagagact

SEQ ID NO: 4980 - DNA, 12 bp, Artificial Sequence
  Description of Artificial Sequence: Synthetic oligonucleotide
gccagagatact

SEQ ID NO: 4981 - DNA, 12 bp, Artificial Sequence
  Description of Artificial Sequence: Synthetic oligonucleotide
gccagaggcact

SEQ ID NO: 4982 - DNA, 12 bp, Artificial Sequence
  Description of Artificial Sequence: Synthetic oligonucleotide
gccagagaggtg

SEQ ID NO: 4983 - DNA, 12 bp, Artificial Sequence
  Description of Artificial Sequence: Synthetic oligonucleotide
gccagagatgtg

SEQ ID NO: 4984 - DNA, 12 bp, Artificial Sequence
  Description of Artificial Sequence: Synthetic oligonucleotide
gccagaggggtg

SEQ ID NO: 4985 - DNA, 15 bp, Artificial Sequence
  Description of Artificial Sequence: Synthetic oligonucleotide
gccagagagggagga

SEQ ID NO: 4986 - DNA, 15 bp, Artificial Sequence
  Description of Artificial Sequence: Synthetic oligonucleotide
gccagagatggtgga

SEQ ID NO: 4987 - DNA, 15 bp, Artificial Sequence
  Description of Artificial Sequence: Synthetic oligonucleotide
gccagaggtggagga

SEQ ID NO: 4988 - DNA, 15 bp, Artificial Sequence
  Description of Artificial Sequence: Synthetic oligonucleotide
gccagagacggcaga

SEQ ID NO: 4989 - DNA, 15 bp, Artificial Sequence
  Description of Artificial Sequence: Synthetic oligonucleotide
gccagaggcggttct

SEQ ID NO: 4990 - DNA, 15 bp, Artificial Sequence
  Description of Artificial Sequence: Synthetic oligonucleotide
gccagaggtgggcct

SEQ ID NO: 4991 - DNA, 15 bp, Artificial Sequence
  Description of Artificial Sequence: Synthetic oligonucleotide
gccagaggaggtgct

SEQ ID NO: 4992 - DNA, 15 bp, Artificial Sequence
  Description of Artificial Sequence: Synthetic oligonucleotide
gccagagacggtact

SEQ ID NO: 4993 - DNA, 15 bp, Artificial Sequence
  Description of Artificial Sequence: Synthetic oligonucleotide
gccagaggtggaact

SEQ ID NO: 4994 - DNA, 15 bp, Artificial Sequence
  Description of Artificial Sequence: Synthetic oligonucleotide
gccagagagggagtg

SEQ ID NO: 4995 - DNA, 15 bp, Artificial Sequence
  Description of Artificial Sequence: Synthetic oligonucleotide
gccagaggtggcgtg

SEQ ID NO: 4996 - DNA, 12 bp, Artificial Sequence
  Description of Artificial Sequence: Synthetic oligonucleotide
gccagaagagga

SEQ ID NO: 4997 - DNA, 15 bp, Artificial Sequence
  Description of Artificial Sequence: Synthetic oligonucleotide
gccagagagcgtgga

SEQ ID NO: 4998 - DNA, 15 bp, Artificial Sequence
  Description of Artificial Sequence: Synthetic oligonucleotide
gccagagatcgtgga

SEQ ID NO: 4999 - DNA, 15 bp, Artificial Sequence
  Description of Artificial Sequence: Synthetic oligonucleotide
gccagaggcagggga

SEQ ID NO: 5000 - DNA, 12 bp, Artificial Sequence
  Description of Artificial Sequence: Synthetic oligonucleotide
gccagatcagga

SEQ ID NO: 5001 - DNA, 15 bp, Artificial Sequence
  Description of Artificial Sequence: Synthetic oligonucleotide
gccagagactcagga

SEQ ID NO: 5002 - DNA, 15 bp, Artificial Sequence
  Description of Artificial Sequence: Synthetic oligonucleotide
gccagagatccagga

SEQ ID NO: 5003 - DNA, 12 bp, Artificial Sequence
  Description of Artificial Sequence: Synthetic oligonucleotide
gccagattggga

SEQ ID NO: 5004 - DNA, 15 bp, Artificial Sequence
  Description of Artificial Sequence: Synthetic oligonucleotide
gccagagacttggga

SEQ ID NO: 5005 - DNA, 12 bp, Artificial Sequence
  Description of Artificial Sequence: Synthetic oligonucleotide
gccagagctgga

SEQ ID NO: 5006 - DNA, 12 bp, Artificial Sequence
  Description of Artificial Sequence: Synthetic oligonucleotide
gccagagtggga

SEQ ID NO: 5007 - DNA, 15 bp, Artificial Sequence
  Description of Artificial Sequence: Synthetic oligonucleotide
gccagaggcgtagga

SEQ ID NO: 5008 - DNA, 12 bp, Artificial Sequence
  Description of Artificial Sequence: Synthetic oligonucleotide
gccagacccaga

SEQ ID NO: 5009 - DNA, 15 bp, Artificial Sequence
  Description of Artificial Sequence: Synthetic oligonucleotide
gccagaggaccaaga

SEQ ID NO: 5010 - DNA, 12 bp, Artificial Sequence
  Description of Artificial Sequence: Synthetic oligonucleotide
gccagaccatct

SEQ ID NO: 5011 - DNA, 15 bp, Artificial Sequence
  Description of Artificial Sequence: Synthetic oligonucleotide
gccagagatccctct

SEQ ID NO: 5012 - DNA, 15 bp, Artificial Sequence
  Description of Artificial Sequence: Synthetic oligonucleotide
gcaagaggaccttct

SEQ ID NO: 5013 - DNA, 15 bp, Artificial Sequence
  Description of Artificial Sequence: Synthetic oligonucleotide
gccagagacccacct

SEQ ID NO: 5014 - DNA, 15 bp, Artificial Sequence
  Description of Artificial Sequence: Synthetic oligonucleotide
gccagaggaccgcct

SEQ ID NO: 5015 - DNA, 12 bp, Artificial Sequence
  Description of Artificial Sequence: Synthetic oligonucleotide
gccagaccgttg

SEQ ID NO: 5016 - DNA, 15 bp, Artificial Sequence
  Description of Artificial Sequence: Synthetic oligonucleotide
gccagagatcctttg

SEQ ID NO: 5017 - DNA, 12 bp, Artificial Sequence
  Description of Artificial Sequence: Synthetic oligonucleotide
gccagaaggcct

SEQ ID NO: 5018 - DNA, 15 bp, Artificial Sequence
  Description of Artificial Sequence: Synthetic oligonucleotide
gccagagaccgtcct

SEQ ID NO: 5019 - DNA, 12 bp, Artificial Sequence
  Description of Artificial Sequence: Synthetic oligonucleotide
gccagatcacct

SEQ ID NO: 5020 - DNA, 12 bp, Artificial Sequence
  Description of Artificial Sequence: Synthetic oligonucleotide
gccagacttcct

SEQ ID NO: 5021 - DNA, 12 bp, Artificial Sequence
  Description of Artificial Sequence: Synthetic oligonucleotide
gccagagcccct

SEQ ID NO: 5022 - DNA, 12 bp, Artificial Sequence
  Description of Artificial Sequence: Synthetic oligonucleotide
gccagaactcct

SEQ ID NO: 5023 - DNA, 12 bp, Artificial Sequence
  Description of Artificial Sequence: Synthetic oligonucleotide
gccagagtccct

SEQ ID NO: 5024 - DNA, 15 bp, Artificial Sequence
  Description of Artificial Sequence: Synthetic oligonucleotide
gccagagttggagga

SEQ ID NO: 5025 - DNA, 12 bp, Artificial Sequence
  Description of Artificial Sequence: Synthetic oligonucleotide
gccagggaccag

SEQ ID NO: 5026 - DNA, 12 bp, Artificial Sequence
  Description of Artificial Sequence: Synthetic oligonucleotide
gcaagagaccac

SEQ ID NO: 5027 - DNA, 12 bp, Artificial Sequence
  Description of Artificial Sequence: Synthetic oligonucleotide
gcaagggctaga

SEQ ID NO: 5028 - DNA, 12 bp, Artificial Sequence
  Description of Artificial Sequence: Synthetic oligonucleotide
gctagggcatct

SEQ ID NO: 5029 - DNA, 15 bp, Artificial Sequence
  Description of Artificial Sequence: Synthetic oligonucleotide
gctagggatcaggga

SEQ ID NO: 5030 - DNA, 12 bp, Artificial Sequence
  Description of Artificial Sequence: Synthetic oligonucleotide
gctagatcaaga

SEQ ID NO: 5031 - DNA, 15 bp, Artificial Sequence
  Description of Artificial Sequence: Synthetic oligonucleotide
gccagggacaggtct

SEQ ID NO: 5032 - DNA, 12 bp, Artificial Sequence
  Description of Artificial Sequence: Synthetic oligonucleotide
gctagatctttg

SEQ ID NO: 5033 - DNA, 12 bp, Artificial Sequence
  Description of Artificial Sequence: Synthetic oligonucleotide
gctaggttgcac

SEQ ID NO: 5034 - DNA, 15 bp, Artificial Sequence
  Description of Artificial Sequence: Synthetic oligonucleotide
gccagggatttgact

SEQ ID NO: 5035 - DNA, 12 bp, Artificial Sequence
  Description of Artificial Sequence: Synthetic oligonucleotide
gcaagagccgag

SEQ ID NO: 5036 - DNA, 15 bp, Artificial Sequence
  Description of Artificial Sequence: Synthetic oligonucleotide
gcaagggatttgtct

SEQ ID NO: 5037 - DNA, 12 bp, Artificial Sequence
  Description of Artificial Sequence: Synthetic oligonucleotide
gctagaggggac

SEQ ID NO: 5038 - DNA, 12 bp, Artificial Sequence
  Description of Artificial Sequence: Synthetic oligonucleotide
gctaggaggaga

SEQ ID NO: 5039 - DNA, 12 bp, Artificial Sequence
  Description of Artificial Sequence: Synthetic oligonucleotide
gctagagataag

SEQ ID NO: 5040 - DNA, 12 bp, Artificial Sequence
  Description of Artificial Sequence: Synthetic oligonucleotide
gctagagtatct

SEQ ID NO: 5041 - DNA, 15 bp, Artificial Sequence
  Description of Artificial Sequence: Synthetic oligonucleotide
gccagagacaggttg

SEQ ID NO: 5042 - DNA, 12 bp, Artificial Sequence
  Description of Artificial Sequence: Synthetic oligonucleotide
gctaggggccag

SEQ ID NO: 5043 - DNA, 12 bp, Artificial Sequence
  Description of Artificial Sequence: Synthetic oligonucleotide
gccagggtcaga

SEQ ID NO: 5044 - DNA, 12 bp, Artificial Sequence
  Description of Artificial Sequence: Synthetic oligonucleotide
gctagggctaag

SEQ ID NO: 5045 - DNA, 12 bp, Artificial Sequence
  Description of Artificial Sequence: Synthetic oligonucleotide
gccaggggtaag

SEQ ID NO: 5046 - DNA, 15 bp, Artificial Sequence
  Description of Artificial Sequence: Synthetic oligonucleotide
gcaagggatatttct

SEQ ID NO: 5047 - DNA, 15 bp, Artificial Sequence
  Description of Artificial Sequence: Synthetic oligonucleotide
gctagggatttcact

SEQ ID NO: 5048 - DNA, 12 bp, Artificial Sequence
  Description of Artificial Sequence: Synthetic oligonucleotide
gccaggcaggga

SEQ ID NO: 5049 - DNA, 12 bp, Artificial Sequence
  Description of Artificial Sequence: Synthetic oligonucleotide
gccaaggaagga

SEQ ID NO: 5050 - DNA, 12 bp, Artificial Sequence
  Description of Artificial Sequence: Synthetic oligonucleotide
gccaaggacgga

SEQ ID NO: 5051 - DNA, 12 bp, Artificial Sequence
  Description of Artificial Sequence: Synthetic oligonucleotide
gccaagggcgga

SEQ ID NO: 5052 - DNA, 12 bp, Artificial Sequence
  Description of Artificial Sequence: Synthetic oligonucleotide
gccaaggaaaga

SEQ ID NO: 5053 - DNA, 12 bp, Artificial Sequence
  Description of Artificial Sequence: Synthetic oligonucleotide
gccaaggacaga

SEQ ID NO: 5054 - DNA, 12 bp, Artificial Sequence
  Description of Artificial Sequence: Synthetic oligonucleotide
gccaagggcaga

SEQ ID NO: 5055 - DNA, 12 bp, Artificial Sequence
  Description of Artificial Sequence: Synthetic oligonucleotide
gccaaggaatct

SEQ ID NO: 5056 - DNA, 12 bp, Artificial Sequence
  Description of Artificial Sequence: Synthetic oligonucleotide
gccaaggattct

SEQ ID NO: 5057 - DNA, 12 bp, Artificial Sequence
  Description of Artificial Sequence: Synthetic oligonucleotide
gccaagggatct

SEQ ID NO: 5058 - DNA, 12 bp, Artificial Sequence
  Description of Artificial Sequence: Synthetic oligonucleotide
gccaaggatcct

SEQ ID NO: 5059 - DNA, 12 bp, Artificial Sequence
  Description of Artificial Sequence: Synthetic oligonucleotide
gccaagggtcct

SEQ ID NO: 5060 - DNA, 12 bp, Artificial Sequence
  Description of Artificial Sequence: Synthetic oligonucleotide
gccaaggacttg

SEQ ID NO: 5061 - DNA, 12 bp, Artificial Sequence
  Description of Artificial Sequence: Synthetic oligonucleotide
gccaaggggttg

SEQ ID NO: 5062 - DNA, 12 bp, Artificial Sequence
  Description of Artificial Sequence: Synthetic oligonucleotide
gccaaggaagct

SEQ ID NO: 5063 - DNA, 12 bp, Artificial Sequence
  Description of Artificial Sequence: Synthetic oligonucleotide
gccaaggacgct

SEQ ID NO: 5064 - DNA, 12 bp, Artificial Sequence
  Description of Artificial Sequence: Synthetic oligonucleotide
gccaagggcgct

SEQ ID NO: 5065 - DNA, 12 bp, Artificial Sequence
  Description of Artificial Sequence: Synthetic oligonucleotide
gccaaggaaact

SEQ ID NO: 5066 - DNA, 12 bp, Artificial Sequence
  Description of Artificial Sequence: Synthetic oligonucleotide
gccaaggatact

SEQ ID NO: 5067 - DNA, 12 bp, Artificial Sequence
  Description of Artificial Sequence: Synthetic oligonucleotide
gccaagggaact

SEQ ID NO: 5068 - DNA, 12 bp, Artificial Sequence
  Description of Artificial Sequence: Synthetic oligonucleotide
gccaaggaagtg

SEQ ID NO: 5069 - DNA, 12 bp, Artificial Sequence
  Description of Artificial Sequence: Synthetic oligonucleotide
gccaaggacgtg

SEQ ID NO: 5070 - DNA, 12 bp, Artificial Sequence
  Description of Artificial Sequence: Synthetic oligonucleotide
gccaagggcgtg

SEQ ID NO: 5071 - DNA, 15 bp, Artificial Sequence
  Description of Artificial Sequence: Synthetic oligonucleotide
gccaaggagggagga

SEQ ID NO: 5072 - DNA, 15 bp, Artificial Sequence
  Description of Artificial Sequence: Synthetic oligonucleotide
gccaaggacggtgga

SEQ ID NO: 5073 - DNA, 15 bp, Artificial Sequence
  Description of Artificial Sequence: Synthetic oligonucleotide
gccaagggaggagga

SEQ ID NO: 5074 - DNA, 15 bp, Artificial Sequence
  Description of Artificial Sequence: Synthetic oligonucleotide
gccaaggacggtaga

SEQ ID NO: 5075 - DNA, 15 bp, Artificial Sequence
  Description of Artificial Sequence: Synthetic oligonucleotide
gccaagggaggttct

SEQ ID NO: 5076 - DNA, 15 bp, Artificial Sequence
  Description of Artificial Sequence: Synthetic oligonucleotide
gccaagggaggtcct

SEQ ID NO: 5077 - DNA, 15 bp, Artificial Sequence
  Description of Artificial Sequence: Synthetic oligonucleotide
gccaagggaggcgct

SEQ ID NO: 5078 - DNA, 15 bp, Artificial Sequence
  Description of Artificial Sequence: Synthetic oligonucleotide
gccaaggatggcact

SEQ ID NO: 5079 - DNA, 15 bp, Artificial Sequence
  Description of Artificial Sequence: Synthetic oligonucleotide
gccaagggaggcact

SEQ ID NO: 5080 - DNA, 15 bp, Artificial Sequence
  Description of Artificial Sequence: Synthetic oligonucleotide
gccaaggaaggagtg

SEQ ID NO: 5081 - DNA, 15 bp, Artificial Sequence
  Description of Artificial Sequence: Synthetic oligonucleotide
gccaagggcggtgtg

SEQ ID NO: 5082 - DNA, 12 bp, Artificial Sequence
  Description of Artificial Sequence: Synthetic oligonucleotide
gccaagagagga

SEQ ID NO: 5083 - DNA, 15 bp, Artificial Sequence
  Description of Artificial Sequence: Synthetic oligonucleotide
gccaaggagagagga

SEQ ID NO: 5084 - DNA, 15 bp, Artificial Sequence
  Description of Artificial Sequence: Synthetic oligonucleotide
gccaaggatagggga

SEQ ID NO: 5085 - DNA, 15 bp, Artificial Sequence
  Description of Artificial Sequence: Synthetic oligonucleotide
gccaagggtagggga

SEQ ID NO: 5086 - DNA, 12 bp, Artificial Sequence
  Description of Artificial Sequence: Synthetic oligonucleotide
gccaagtctgga

SEQ ID NO: 5087 - DNA, 15 bp, Artificial Sequence
  Description of Artificial Sequence: Synthetic oligonucleotide
gccaaggatagtgga

SEQ ID NO: 5088 - DNA, 15 bp, Artificial Sequence
  Description of Artificial Sequence: Synthetic oligonucleotide
gccaaggaccccgga

SEQ ID NO: 5089 - DNA, 12 bp, Artificial Sequence
  Description of Artificial Sequence: Synthetic oligonucleotide
gccaagttagga

SEQ ID NO: 5090 - DNA, 15 bp, Artificial Sequence
  Description of Artificial Sequence: Synthetic oligonucleotide
gccaaggatcttgga

SEQ ID NO: 5091 - DNA, 12 bp, Artificial Sequence
  Description of Artificial Sequence: Synthetic oligonucleotide
gccaaggctgga

SEQ ID NO: 5092 - DNA, 12 bp, Artificial Sequence
  Description of Artificial Sequence: Synthetic oligonucleotide
gccaaggtagga

SEQ ID NO: 5093 - DNA, 15 bp, Artificial Sequence
  Description of Artificial Sequence: Synthetic oligonucleotide
gccaagggtgtcgga

SEQ ID NO: 5094 - DNA, 12 bp, Artificial Sequence
  Description of Artificial Sequence: Synthetic oligonucleotide
gccaagcctaga

SEQ ID NO: 5095 - DNA, 15 bp, Artificial Sequence
  Description of Artificial Sequence: Synthetic oligonucleotide
gccaagggccccaga

SEQ ID NO: 5096 - DNA, 12 bp, Artificial Sequence
  Description of Artificial Sequence: Synthetic oligonucleotide
gccaagccttct

SEQ ID NO: 5097 - DNA, 15 bp, Artificial Sequence
  Description of Artificial Sequence: Synthetic oligonucleotide
gccaaggatccctct

SEQ ID NO: 5098 - DNA, 15 bp, Artificial Sequence
  Description of Artificial Sequence: Synthetic oligonucleotide
gccaaagggccatct

SEQ ID NO: 5099 - DNA, 15 bp, Artificial Sequence
  Description of Artificial Sequence: Synthetic oligonucleotide
gccaaggatccacct

SEQ ID NO: 5100 - DNA, 15 bp, Artificial Sequence
  Description of Artificial Sequence: Synthetic oligonucleotide
gccaagggccctcct

SEQ ID NO: 5101 - DNA, 12 bp, Artificial Sequence
  Description of Artificial Sequence: Synthetic oligonucleotide
gccaagccgttg

SEQ ID NO: 5102 - DNA, 15 bp, Artificial Sequence
  Description of Artificial Sequence: Synthetic oligonucleotide
gccaaggaccctttg

SEQ ID NO: 5103 - DNA, 12 bp, Artificial Sequence
  Description of Artificial Sequence: Synthetic oligonucleotide
gccaagaggcct

SEQ ID NO: 5104 - DNA, 15 bp, Artificial Sequence
  Description of Artificial Sequence: Synthetic oligonucleotide
gccaaggaccgtcct

SEQ ID NO: 5105 - DNA, 12 bp, Artificial Sequence
  Description of Artificial Sequence: Synthetic oligonucleotide
gccaagagtcct

SEQ ID NO: 5106 - DNA, 12 bp, Artificial Sequence
  Description of Artificial Sequence: Synthetic oligonucleotide
gccaagctacct

SEQ ID NO: 5107 - DNA, 12 bp, Artificial Sequence
  Description of Artificial Sequence: Synthetic oligonucleotide
gccaaggctcct

SEQ ID NO: 5108 - DNA, 12 bp, Artificial Sequence
  Description of Artificial Sequence: Synthetic oligonucleotide
gccaagacgcct

SEQ ID NO: 5109 - DNA, 12 bp, Artificial Sequence
  Description of Artificial Sequence: Synthetic oligonucleotide
gccaaggtacct

SEQ ID NO: 5110 - DNA, 15 bp, Artificial Sequence
  Description of Artificial Sequence: Synthetic oligonucleotide
gccaaggtgggtgga

SEQ ID NO: 5111 - DNA, 12 bp, Artificial Sequence
  Description of Artificial Sequence: Synthetic oligonucleotide
gccaaggatcag

SEQ ID NO: 5112 - DNA, 12 bp, Artificial Sequence
  Description of Artificial Sequence: Synthetic oligonucleotide
gctaaagaccac

SEQ ID NO: 5113 - DNA, 12 bp, Artificial Sequence
  Description of Artificial Sequence: Synthetic oligonucleotide
gccaaggcaaga

SEQ ID NO: 5114 - DNA, 12 bp, Artificial Sequence
  Description of Artificial Sequence: Synthetic oligonucleotide
gccaaggcatct

SEQ ID NO: 5115 - DNA, 15 bp, Artificial Sequence
  Description of Artificial Sequence: Synthetic oligonucleotide
gcaaaggatcaggga

SEQ ID NO: 5116 - DNA, 12 bp, Artificial Sequence
  Description of Artificial Sequence: Synthetic oligonucleotide
gccaagagtaga

SEQ ID NO: 5117 - DNA, 15 bp, Artificial Sequence
  Description of Artificial Sequence: Synthetic oligonucleotide
gcaaaagacaggtct

SEQ ID NO: 5118 - DNA, 12 bp, Artificial Sequence
  Description of Artificial Sequence: Synthetic oligonucleotide
gcaaagagcttg

SEQ ID NO: 5119 - DNA, 12 bp, Artificial Sequence
  Description of Artificial Sequence: Synthetic oligonucleotide
gctaaattgcac

SEQ ID NO: 5120 - DNA, 15 bp, Artificial Sequence
  Description of Artificial Sequence: Synthetic oligonucleotide
gccaaggacttgact

SEQ ID NO: 5121 - DNA, 12 bp, Artificial Sequence
  Description of Artificial Sequence: Synthetic oligonucleotide
gctaaagcagag

SEQ ID NO: 5122 - DNA, 15 bp, Artificial Sequence
  Description of Artificial Sequence: Synthetic oligonucleotide
gcaaaagacttgtct

SEQ ID NO: 5123 - DNA, 12 bp, Artificial Sequence
  Description of Artificial Sequence: Synthetic oligonucleotide
gcaaaaggggac

SEQ ID NO: 5124 - DNA, 12 bp, Artificial Sequence
  Description of Artificial Sequence: Synthetic oligonucleotide
gcaaaaaggaga

SEQ ID NO: 5125 - DNA, 12 bp, Artificial Sequence
  Description of Artificial Sequence: Synthetic oligonucleotide
gcaaaagacaag

SEQ ID NO: 5126 - DNA, 12 bp, Artificial Sequence
  Description of Artificial Sequence: Synthetic oligonucleotide
gccaaagtatct

SEQ ID NO: 5127 - DNA, 15 bp, Artificial Sequence
  Description of Artificial Sequence: Synthetic oligonucleotide
gcaaaagacaggttg

SEQ ID NO: 5128 - DNA, 12 bp, Artificial Sequence
  Description of Artificial Sequence: Synthetic oligonucleotide
gccaaaggacag

SEQ ID NO: 5129 - DNA, 12 bp, Artificial Sequence
  Description of Artificial Sequence: Synthetic oligonucleotide
gcaaaagtcaga

SEQ ID NO: 5130 - DNA, 12 bp, Artificial Sequence
  Description of Artificial Sequence: Synthetic oligonucleotide
gcaaaggcaaag

SEQ ID NO: 5131 - DNA, 12 bp, Artificial Sequence
  Description of Artificial Sequence: Synthetic oligonucleotide
gcaaagggcaag

SEQ ID NO: 5132 - DNA, 15 bp, Artificial Sequence
  Description of Artificial Sequence: Synthetic oligonucleotide
gcaaaggacatttct

SEQ ID NO: 5133 - DNA, 15 bp, Artificial Sequence
  Description of Artificial Sequence: Synthetic oligonucleotide
gctaaagatttcact

SEQ ID NO: 5134 - DNA, 12 bp, Artificial Sequence
  Description of Artificial Sequence: Synthetic oligonucleotide
gccaagcaagga

SEQ ID NO: 5135 - DNA, 12 bp, Artificial Sequence
  Description of Artificial Sequence: Synthetic oligonucleotide
gttggcgcaact

SEQ ID NO: 5136 - DNA, 15 bp, Artificial Sequence
  Description of Artificial Sequence: Synthetic oligonucleotide
tactctggctcttat

SEQ ID NO: 5137 - DNA, 18 bp, Artificial Sequence
  Description of Artificial Sequence: Synthetic oligonucleotide
tgtagtagtacaagttgc

SEQ ID NO: 5138 - DNA, 21 bp, Artificial Sequence
  Description of Artificial Sequence: Synthetic oligonucleotide
tgctcatctacatcatgctat

SEQ ID NO: 5139 - DNA, 21 bp, Artificial Sequence
  Description of Artificial Sequence: Synthetic oligonucleotide
tattgttcaagtacatcttgt

SEQ ID NO: 5140 - DNA, 24 bp, Artificial Sequence
  Description of Artificial Sequence: Synthetic oligonucleotide
gggtattgctccagtacctcatgt

SEQ ID NO: 5141 - DNA, 24 bp, Artificial Sequence
  Description of Artificial Sequence: Synthetic oligonucleotide
tactgcagcagcacaagttgttac

SEQ ID NO: 5142 - DNA, 27 bp, Artificial Sequence
  Description of Artificial Sequence: Synthetic oligonucleotide
gggtattgcagttcaactagttgttat

SEQ ID NO: 5143 - DNA, 27 bp, Artificial Sequence
  Description of Artificial Sequence: Synthetic oligonucleotide
tactgttcatcaacctcctgttatact

SEQ ID NO: 5144 - DNA, 21 bp, Artificial Sequence
  Description of Artificial Sequence: Synthetic oligonucleotide
tgctctgggggtagctgctat

SEQ ID NO: 5145 - DNA, 21 bp, Artificial Sequence
  Description of Artificial Sequence: Synthetic oligonucleotide
tactgtagcggtggtagttgc

SEQ ID NO: 5146 - DNA, 24 bp, Artificial Sequence
  Description of Artificial Sequence: Synthetic oligonucleotide
ggatactgtagtggcggatcctgc

SEQ ID NO: 5147 - DNA, 24 bp, Artificial Sequence
  Description of Artificial Sequence: Synthetic oligonucleotide
tactgctccggaggaagttgttat

SEQ ID NO: 5148 - DNA, 27 bp, Artificial Sequence
  Description of Artificial Sequence: Synthetic oligonucleotide
ggttattgcagtgggggttcatgttac

SEQ ID NO: 5149 - DNA, 27 bp, Artificial Sequence
  Description of Artificial Sequence: Synthetic oligonucleotide
tactgttccggaggtagctgttactct

SEQ ID NO: 5150 - DNA, 24 bp, Artificial Sequence
  Description of Artificial Sequence: Synthetic oligonucleotide
gcctattgcggtggtgactgctat

SEQ ID NO: 5151 - DNA, 21 bp, Artificial Sequence
  Description of Artificial Sequence: Synthetic oligonucleotide
gcatattgcggaggggattgc

SEQ ID NO: 5152 - DNA, 21 bp, Artificial Sequence
  Description of Artificial Sequence: Synthetic oligonucleotide
tattgtggtggggactgctat

SEQ ID NO: 5153 - DNA, 18 bp, Artificial Sequence
  Description of Artificial Sequence: Synthetic oligonucleotide
tactgcggaggcgattgc

SEQ ID NO: 5154 - DNA, 30 bp, Artificial Sequence
  Description of Artificial Sequence: Synthetic oligonucleotide
gggtactgctctagcacttcatgctacgcc

SEQ ID NO: 5155 - DNA, 15 bp, Artificial Sequence
  Description of Artificial Sequence: Synthetic oligonucleotide
ccagcagctatgcct

SEQ ID NO: 5156 - DNA, 15 bp, Artificial Sequence
  Description of Artificial Sequence: Synthetic oligonucleotide
gtctatgcaattcct

SEQ ID NO: 5157 - DNA, 12 bp, Artificial Sequence
  Description of Artificial Sequence: Synthetic oligonucleotide
tggtttggggag

SEQ ID NO: 5158 - DNA, 12 bp, Artificial Sequence
  Description of Artificial Sequence: Synthetic oligonucleotide
agtggatcttat

SEQ ID NO: 5159 - DNA, 12 bp, Artificial Sequence
  Description of Artificial Sequence: Synthetic oligonucleotide
tattatggcagt

SEQ ID NO: 5160 - DNA, 12 bp, Artificial Sequence
  Description of Artificial Sequence: Synthetic oligonucleotide
tactactatggc

SEQ ID NO: 5161 - DNA, 15 bp, Artificial Sequence
  Description of Artificial Sequence: Synthetic oligonucleotide
ggcagcggttcctac

SEQ ID NO: 5162 - DNA, 15 bp, Artificial Sequence
  Description of Artificial Sequence: Synthetic oligonucleotide
agtggatcctattac

SEQ ID NO: 5163 - DNA, 18 bp, Artificial Sequence
  Description of Artificial Sequence: Synthetic oligonucleotide
tattactacgggtctggc

SEQ ID NO: 5164 - DNA, 21 bp, Artificial Sequence
  Description of Artificial Sequence: Synthetic oligonucleotide
tattactacggatctggctct

SEQ ID NO: 5165 - DNA, 24 bp, Artificial Sequence
  Description of Artificial Sequence: Synthetic oligonucleotide
tattactatggctctggtagctac

SEQ ID NO: 5166 - DNA, 12 bp, Artificial Sequence
  Description of Artificial Sequence: Synthetic oligonucleotide
atggtaagaggt

SEQ ID NO: 5167 - DNA, 15 bp, Artificial Sequence
  Description of Artificial Sequence: Synthetic oligonucleotide
accatggtgaggggt

SEQ ID NO: 5168 - DNA, 36 bp, Artificial Sequence
  Description of Artificial Sequence: Synthetic oligonucleotide
tactatgattacgtctgggggtcttatgcttacact

SEQ ID NO: 5169 - DNA, 33 bp, Artificial Sequence
  Description of Artificial Sequence: Synthetic oligonucleotide
tactacgactatgtatggggctcatatgcttac

SEQ ID NO: 5170 - DNA, 30 bp, Artificial Sequence
  Description of Artificial Sequence: Synthetic oligonucleotide
tactacgattacgtatggggaagctacgct

SEQ ID NO: 5171 - DNA, 30 bp, Artificial Sequence
  Description of Artificial Sequence: Synthetic oligonucleotide
tatgattatgtgtgggggtcatacgcatac

SEQ ID NO: 5172 - DNA, 30 bp, Artificial Sequence
  Description of Artificial Sequence: Synthetic oligonucleotide
gattatgtgtgggggtcttacgcctacacc

SEQ ID NO: 5173 - DNA, 27 bp, Artificial Sequence
  Description of Artificial Sequence: Synthetic oligonucleotide
tacgactatgtgtggggttcctatgct

SEQ ID NO: 5174 - DNA, 12 bp, Artificial Sequence
  Description of Artificial Sequence: Synthetic oligonucleotide
tactacgattcc

SEQ ID NO: 5175 - DNA, 12 bp, Artificial Sequence
  Description of Artificial Sequence: Synthetic oligonucleotide
tattattatgac

SEQ ID NO: 5176 - DNA, 15 bp, Artificial Sequence
  Description of Artificial Sequence: Synthetic oligonucleotide
gacagttccgggtac

SEQ ID NO: 5177 - DNA, 15 bp, Artificial Sequence
  Description of Artificial Sequence: Synthetic oligonucleotide
tatgatagctcaggt

SEQ ID NO: 5178 - DNA, 15 bp, Artificial Sequence
  Description of Artificial Sequence: Synthetic oligonucleotide
tactatgactcatcc

SEQ ID NO: 5179 - DNA, 15 bp, Artificial Sequence
  Description of Artificial Sequence: Synthetic oligonucleotide
tattattacgatagt

SEQ ID NO: 5180 - DNA, 18 bp, Artificial Sequence
  Description of Artificial Sequence: Synthetic oligonucleotide
gattcttccgggtactac

SEQ ID NO: 5181 - DNA, 18 bp, Artificial Sequence
  Description of Artificial Sequence: Synthetic oligonucleotide
tatgattccagcggatac

SEQ ID NO: 5182 - DNA, 18 bp, Artificial Sequence
  Description of Artificial Sequence: Synthetic oligonucleotide
tactacgatagctccggt

SEQ ID NO: 5183 - DNA, 18 bp, Artificial Sequence
  Description of Artificial Sequence: Synthetic oligonucleotide
tattattacgactcttcc

SEQ ID NO: 5184 - DNA, 21 bp, Artificial Sequence
  Description of Artificial Sequence: Synthetic oligonucleotide
tacgactcttctggttattac

SEQ ID NO: 5185 - DNA, 21 bp, Artificial Sequence
  Description of Artificial Sequence: Synthetic oligonucleotide
tattatgacagcagcgggtat

SEQ ID NO: 5186 - DNA, 21 bp, Artificial Sequence
  Description of Artificial Sequence: Synthetic oligonucleotide
tactactacgattccagcggt

SEQ ID NO: 5187 - DNA, 24 bp, Artificial Sequence
  Description of Artificial Sequence: Synthetic oligonucleotide
tacgacagttccggatattattac

SEQ ID NO: 5188 - DNA, 24 bp, Artificial Sequence
  Description of Artificial Sequence: Synthetic oligonucleotide
tactatgatagtagtgggtactat

SEQ ID NO: 5189 - DNA, 24 bp, Artificial Sequence
  Description of Artificial Sequence: Synthetic oligonucleotide
tactactatgacagctcagggtat

SEQ ID NO: 5190 - DNA, 27 bp, Artificial Sequence
  Description of Artificial Sequence: Synthetic oligonucleotide
tattacgacagcagtggctactactat

SEQ ID NO: 5191 - DNA, 27 bp, Artificial Sequence
  Description of Artificial Sequence: Synthetic oligonucleotide
tactactacgatagctctggatactat

SEQ ID NO: 5192 - DNA, 30 bp, Artificial Sequence
  Description of Artificial Sequence: Synthetic oligonucleotide
tattattacgattccagtggttattattat

SEQ ID NO: 5193 - DNA, 12 bp, Artificial Sequence
  Description of Artificial Sequence: Synthetic oligonucleotide
gactcatccggt

SEQ ID NO: 5194 - DNA, 12 bp, Artificial Sequence
  Description of Artificial Sequence: Synthetic oligonucleotide
ggttactattac

SEQ ID NO: 5195 - DNA, 12 bp, Artificial Sequence
  Description of Artificial Sequence: Synthetic oligonucleotide
agcggctactat

SEQ ID NO: 5196 - DNA, 15 bp, Artificial Sequence
  Description of Artificial Sequence: Synthetic oligonucleotide
agatttttggagtgg

SEQ ID NO: 5197 - DNA, 30 bp, Artificial Sequence
  Description of Artificial Sequence: Synthetic oligonucleotide
tactatgatttttggagtggatattatacc

SEQ ID NO: 5198 - DNA, 18 bp, Artificial Sequence
  Description of Artificial Sequence: Synthetic oligonucleotide
tatgatttttggtctggt

SEQ ID NO: 5199 - DNA, 18 bp, Artificial Sequence
  Description of Artificial Sequence: Synthetic oligonucleotide
gatttttggagcggctat

SEQ ID NO: 5200 - DNA, 15 bp, Artificial Sequence
  Description of Artificial Sequence: Synthetic oligonucleotide
ttttggagcgggtat

SEQ ID NO: 5201 - DNA, 27 bp, Artificial Sequence
  Description of Artificial Sequence: Synthetic oligonucleotide
tactacgacttctggagcgggtattac

SEQ ID NO: 5202 - DNA, 24 bp, Artificial Sequence
  Description of Artificial Sequence: Synthetic oligonucleotide
tactacgatttttggtctggatat

SEQ ID NO: 5203 - DNA, 24 bp, Artificial Sequence
  Description of Artificial Sequence: Synthetic oligonucleotide
tatgacttttggagtggttactac

SEQ ID NO: 5204 - DNA, 21 bp, Artificial Sequence
  Description of Artificial Sequence: Synthetic oligonucleotide
tactacgatttctggtcaggc

SEQ ID NO: 5205 - DNA, 21 bp, Artificial Sequence
  Description of Artificial Sequence: Synthetic oligonucleotide
tatgacttctggagtggttac

SEQ ID NO: 5206 - DNA, 21 bp, Artificial Sequence
  Description of Artificial Sequence: Synthetic oligonucleotide
gacttctggtcaggatactac

SEQ ID NO: 5207 - DNA, 15 bp, Artificial Sequence
  Description of Artificial Sequence: Synthetic oligonucleotide
gtgttgaggtacttc

SEQ ID NO: 5208 - DNA, 15 bp, Artificial Sequence
  Description of Artificial Sequence: Synthetic oligonucleotide
ttaagatactttgat

SEQ ID NO: 5209 - DNA, 15 bp, Artificial Sequence
  Description of Artificial Sequence: Synthetic oligonucleotide
agatactttgattgg

SEQ ID NO: 5210 - DNA, 12 bp, Artificial Sequence
  Description of Artificial Sequence: Synthetic oligonucleotide
gtgttgaggtat

SEQ ID NO: 5211 - DNA, 12 bp, Artificial Sequence
  Description of Artificial Sequence: Synthetic oligonucleotide
ttgagatatttc

SEQ ID NO: 5212 - DNA, 12 bp, Artificial Sequence
  Description of Artificial Sequence: Synthetic oligonucleotide
agatactttgat

SEQ ID NO: 5213 - DNA, 24 bp, Artificial Sequence
  Description of Artificial Sequence: Synthetic oligonucleotide
gtcttaaggtacttcgattggctt

SEQ ID NO: 5214 - DNA, 21 bp, Artificial Sequence
  Description of Artificial Sequence: Synthetic oligonucleotide
gtcttaagatactttgattgg

SEQ ID NO: 5215 - DNA, 18 bp, Artificial Sequence
  Description of Artificial Sequence: Synthetic oligonucleotide
gtgttgaggtactttgac

SEQ ID NO: 5216 - DNA, 18 bp, Artificial Sequence
  Description of Artificial Sequence: Synthetic oligonucleotide
ttaagatacttcgattgg

SEQ ID NO: 5217 - DNA, 18 bp, Artificial Sequence
  Description of Artificial Sequence: Synthetic oligonucleotide
agatatttcgactggctt

SEQ ID NO: 5218 - DNA, 24 bp, Artificial Sequence
  Description of Artificial Sequence: Synthetic oligonucleotide
tatgacatattgactggctactac

SEQ ID NO: 5219 - DNA, 21 bp, Artificial Sequence
  Description of Artificial Sequence: Synthetic oligonucleotide
tatgatatattaactgggtac

SEQ ID NO: 5220 - DNA, 21 bp, Artificial Sequence
  Description of Artificial Sequence: Synthetic oligonucleotide
gatatcttaaccgggtattat

SEQ ID NO: 5221 - DNA, 12 bp, Artificial Sequence
  Description of Artificial Sequence: Synthetic oligonucleotide
gattacggcgat

SEQ ID NO: 5222 - DNA, 12 bp, Artificial Sequence
  Description of Artificial Sequence: Synthetic oligonucleotide
tacggcgattat

SEQ ID NO: 5223 - DNA, 15 bp, Artificial Sequence
  Description of Artificial Sequence: Synthetic oligonucleotide
gactacggagattat

SEQ ID NO: 5224 - DNA, 15 bp, Artificial Sequence
  Description of Artificial Sequence: Synthetic oligonucleotide
accacagtaaccacc

SEQ ID NO: 5225 - DNA, 12 bp, Artificial Sequence
  Description of Artificial Sequence: Synthetic oligonucleotide
acaactgtgact

SEQ ID NO: 5226 - DNA, 12 bp, Artificial Sequence
  Description of Artificial Sequence: Synthetic oligonucleotide
acagtaactact

SEQ ID NO: 5227 - DNA, 18 bp, Artificial Sequence
  Description of Artificial Sequence: Synthetic oligonucleotide
ggctactcaggatacgac

SEQ ID NO: 5228 - DNA, 15 bp, Artificial Sequence
  Description of Artificial Sequence: Synthetic oligonucleotide
tatagcggatatgac

SEQ ID NO: 5229 - DNA, 12 bp, Artificial Sequence
  Description of Artificial Sequence: Synthetic oligonucleotide
agagatggttac

SEQ ID NO: 5230 - DNA, 12 bp, Artificial Sequence
  Description of Artificial Sequence: Synthetic oligonucleotide
gatactgctatg

SEQ ID NO: 5231 - DNA, 12 bp, Artificial Sequence
  Description of Artificial Sequence: Synthetic oligonucleotide
tattcatatggt

SEQ ID NO: 5232 - DNA, 15 bp, Artificial Sequence
  Description of Artificial Sequence: Synthetic oligonucleotide
ggatatagttatggc

SEQ ID NO: 5233 - DNA, 18 bp, Artificial Sequence
  Description of Artificial Sequence: Synthetic oligonucleotide
tacagtagctcttggtac

SEQ ID NO: 5234 - DNA, 21 bp, Artificial Sequence
  Description of Artificial Sequence: Synthetic oligonucleotide
ggctacagttcaagctggtat

SEQ ID NO: 5235 - DNA, 12 bp, Artificial Sequence
  Description of Artificial Sequence: Synthetic oligonucleotide
agtagctcttgg

SEQ ID NO: 5236 - DNA, 12 bp, Artificial Sequence
  Description of Artificial Sequence: Synthetic oligonucleotide
tacagcagctcc

SEQ ID NO: 5237 - DNA, 15 bp, Artificial Sequence
  Description of Artificial Sequence: Synthetic oligonucleotide
tactcttcctcatgg

SEQ ID NO: 5238 - DNA, 12 bp, Artificial Sequence
  Description of Artificial Sequence: Synthetic oligonucleotide
cagcaattggtt

SEQ ID NO: 5239 - DNA, 15 bp, Artificial Sequence
  Description of Artificial Sequence: Synthetic oligonucleotide
agctctggatggtac

SEQ ID NO: 5240 - DNA, 15 bp, Artificial Sequence
  Description of Artificial Sequence: Synthetic oligonucleotide
tatagtagcggatgg

SEQ ID NO: 5241 - DNA, 18 bp, Artificial Sequence
  Description of Artificial Sequence: Synthetic oligonucleotide
tatagcagcggttggtac

SEQ ID NO: 5242 - DNA, 21 bp, Artificial Sequence
  Description of Artificial Sequence: Synthetic oligonucleotide
ggttattcatcaggttggtat

SEQ ID NO: 5243 - DNA, 12 bp, Artificial Sequence
  Description of Artificial Sequence: Synthetic oligonucleotide
agtggttggtat

SEQ ID NO: 5244 - DNA, 12 bp, Artificial Sequence
  Description of Artificial Sequence: Synthetic oligonucleotide
agttccggttgg

SEQ ID NO: 5245 - DNA, 12 bp, Artificial Sequence
  Description of Artificial Sequence: Synthetic oligonucleotide
tactcaagtggt

SEQ ID NO: 5246 - DNA, 12 bp, Artificial Sequence
  Description of Artificial Sequence: Synthetic oligonucleotide
cagtggttagtt

SEQ ID NO: 5247 - DNA, 12 bp, Artificial Sequence
  Description of Artificial Sequence: Synthetic oligonucleotide
gagtactcatcc

SEQ ID NO: 5248 - DNA, 18 bp, Artificial Sequence
  Description of Artificial Sequence: Synthetic oligonucleotide
agcatagcagcaaggcct

SEQ ID NO: 5249 - DNA, 15 bp, Artificial Sequence
  Description of Artificial Sequence: Synthetic oligonucleotide
atagcagcaaggcct

SEQ ID NO: 5250 - DNA, 12 bp, Artificial Sequence
  Description of Artificial Sequence: Synthetic oligonucleotide
gccgcaagacct

SEQ ID NO: 5251 - DNA, 12 bp, Artificial Sequence
  Description of Artificial Sequence: Synthetic oligonucleotide
gccttcgatatc

SEQ ID NO: 5252 - DNA, 12 bp, Artificial Sequence
  Description of Artificial Sequence: Synthetic oligonucleotide
gccttcgattac

SEQ ID NO: 5253 - DNA, 12 bp, Artificial Sequence
  Description of Artificial Sequence: Synthetic oligonucleotide
gatttcgactat

SEQ ID NO: 5254 - DNA, 12 bp, Artificial Sequence
  Description of Artificial Sequence: Synthetic oligonucleotide
ttcttcgattac

SEQ ID NO: 5255 - DNA, 12 bp, Artificial Sequence
  Description of Artificial Sequence: Synthetic oligonucleotide
gggtttgaccca

SEQ ID NO: 5256 - DNA, 12 bp, Artificial Sequence
  Description of Artificial Sequence: Synthetic oligonucleotide
gggttcgactac

SEQ ID NO: 5257 - DNA, 12 bp, Artificial Sequence
  Description of Artificial Sequence: Synthetic oligonucleotide
ggcatggatgta

SEQ ID NO: 5258 - DNA, 12 bp, Artificial Sequence
  Description of Artificial Sequence: Synthetic oligonucleotide
cactttgactat

SEQ ID NO: 5259 - DNA, 12 bp, Artificial Sequence
  Description of Artificial Sequence: Synthetic oligonucleotide
atattcgattac

SEQ ID NO: 5260 - DNA, 12 bp, Artificial Sequence
  Description of Artificial Sequence: Synthetic oligonucleotide
ttatttgattat

SEQ ID NO: 5261 - DNA, 12 bp, Artificial Sequence
  Description of Artificial Sequence: Synthetic oligonucleotide
aactttgattac

SEQ ID NO: 5262 - DNA, 12 bp, Artificial Sequence
  Description of Artificial Sequence: Synthetic oligonucleotide
cccttcgactat

SEQ ID NO: 5263 - DNA, 12 bp, Artificial Sequence
  Description of Artificial Sequence: Synthetic oligonucleotide
aggtttgactat

SEQ ID NO: 5264 - DNA, 12 bp, Artificial Sequence
  Description of Artificial Sequence: Synthetic oligonucleotide
agtttcgattac

SEQ ID NO: 5265 - DNA, 12 bp, Artificial Sequence
  Description of Artificial Sequence: Synthetic oligonucleotide
acatttgactac

SEQ ID NO: 5266 - DNA, 12 bp, Artificial Sequence
  Description of Artificial Sequence: Synthetic oligonucleotide
gttttcgattat

SEQ ID NO: 5267 - DNA, 12 bp, Artificial Sequence
  Description of Artificial Sequence: Synthetic oligonucleotide
tggttcgatcca

SEQ ID NO: 5268 - DNA, 12 bp, Artificial Sequence
  Description of Artificial Sequence: Synthetic oligonucleotide
tatttcgactta

SEQ ID NO: 5269 - DNA, 12 bp, Artificial Sequence
  Description of Artificial Sequence: Synthetic oligonucleotide
tacttcgattac

SEQ ID NO: 5270 - DNA, 12 bp, Artificial Sequence
  Description of Artificial Sequence: Synthetic oligonucleotide
tatttccagcac

SEQ ID NO: 5271 - DNA, 12 bp, Artificial Sequence
  Description of Artificial Sequence: Synthetic oligonucleotide
tatatggatgtc

SEQ ID NO: 5272 - DNA, 15 bp, Artificial Sequence
  Description of Artificial Sequence: Synthetic oligonucleotide
gatgccttcgacata

SEQ ID NO: 5273 - DNA, 15 bp, Artificial Sequence
  Description of Artificial Sequence: Synthetic oligonucleotide
gactggtttgacccc

SEQ ID NO: 5274 - DNA, 15 bp, Artificial Sequence
  Description of Artificial Sequence: Synthetic oligonucleotide
gactactttgattac

SEQ ID NO: 5275 - DNA, 15 bp, Artificial Sequence
  Description of Artificial Sequence: Synthetic oligonucleotide
gaatacttccaacac

SEQ ID NO: 5276 - DNA, 15 bp, Artificial Sequence
  Description of Artificial Sequence: Synthetic oligonucleotide
ggcgcattcgatatt

SEQ ID NO: 5277 - DNA, 15 bp, Artificial Sequence
  Description of Artificial Sequence: Synthetic oligonucleotide
gggtggtttgatcca

SEQ ID NO: 5278 - DNA, 15 bp, Artificial Sequence
  Description of Artificial Sequence: Synthetic oligonucleotide
ggctattttgactac

SEQ ID NO: 5279 - DNA, 15 bp, Artificial Sequence
  Description of Artificial Sequence: Synthetic oligonucleotide
catgcttttgatata

SEQ ID NO: 5280 - DNA, 15 bp, Artificial Sequence
  Description of Artificial Sequence: Synthetic oligonucleotide
cattacttcgattac

SEQ ID NO: 5281 - DNA, 15 bp, Artificial Sequence
  Description of Artificial Sequence: Synthetic oligonucleotide
aacgcattcgatatt

SEQ ID NO: 5282 - DNA, 15 bp, Artificial Sequence
  Description of Artificial Sequence: Synthetic oligonucleotide
aactggttcgatcca

SEQ ID NO: 5283 - DNA, 15 bp, Artificial Sequence
  Description of Artificial Sequence: Synthetic oligonucleotide
aattatttcgactat

SEQ ID NO: 5284 - DNA, 15 bp, Artificial Sequence
  Description of Artificial Sequence: Synthetic oligonucleotide
ccctactttgactat

SEQ ID NO: 5285 - DNA, 15 bp, Artificial Sequence
  Description of Artificial Sequence: Synthetic oligonucleotide
agagcctttgatatc

SEQ ID NO: 5286 - DNA, 15 bp, Artificial Sequence
  Description of Artificial Sequence: Synthetic oligonucleotide
aggtacttcgattac

SEQ ID NO: 5287 - DNA, 15 bp, Artificial Sequence
  Description of Artificial Sequence: Synthetic oligonucleotide
tcatggttcgacccc

SEQ ID NO: 5288 - DNA, 15 bp, Artificial Sequence
  Description of Artificial Sequence: Synthetic oligonucleotide
agttactttgactat

SEQ ID NO: 5289 - DNA, 15 bp, Artificial Sequence
  Description of Artificial Sequence: Synthetic oligonucleotide
acttatttcgactac

SEQ ID NO: 5290 - DNA, 15 bp, Artificial Sequence
  Description of Artificial Sequence: Synthetic oligonucleotide
gtggccttcgacatt

SEQ ID NO: 5291 - DNA, 15 bp, Artificial Sequence
  Description of Artificial Sequence: Synthetic oligonucleotide
gtctattttgattat

SEQ ID NO: 5292 - DNA, 15 bp, Artificial Sequence
  Description of Artificial Sequence: Synthetic oligonucleotide
tggtatttcgatttg

SEQ ID NO: 5293 - DNA, 15 bp, Artificial Sequence
  Description of Artificial Sequence: Synthetic oligonucleotide
tacgcatttgacatc

SEQ ID NO: 5294 - DNA, 15 bp, Artificial Sequence
  Description of Artificial Sequence: Synthetic oligonucleotide
tacggcatggacgtg

SEQ ID NO: 5295 - DNA, 15 bp, Artificial Sequence
  Description of Artificial Sequence: Synthetic oligonucleotide
tattattttgattac

SEQ ID NO: 5296 - DNA, 15 bp, Artificial Sequence
  Description of Artificial Sequence: Synthetic oligonucleotide
tattatatggacgtc

SEQ ID NO: 5297 - DNA, 18 bp, Artificial Sequence
  Description of Artificial Sequence: Synthetic oligonucleotide
gcagagtacttccagcac

SEQ ID NO: 5298 - DNA, 18 bp, Artificial Sequence
  Description of Artificial Sequence: Synthetic oligonucleotide
gacaattggtttgatccc

SEQ ID NO: 5299 - DNA, 18 bp, Artificial Sequence
  Description of Artificial Sequence: Synthetic oligonucleotide
gattggtacttcgacttg

SEQ ID NO: 5300 - DNA, 18 bp, Artificial Sequence
  Description of Artificial Sequence: Synthetic oligonucleotide
gggaattggtttgatcct

SEQ ID NO: 5301 - DNA, 18 bp, Artificial Sequence
  Description of Artificial Sequence: Synthetic oligonucleotide
aactggtatttcgactta

SEQ ID NO: 5302 - DNA, 18 bp, Artificial Sequence
  Description of Artificial Sequence: Synthetic oligonucleotide
cccaattggtttgatcca

SEQ ID NO: 5303 - DNA, 18 bp, Artificial Sequence
  Description of Artificial Sequence: Synthetic oligonucleotide
agtaattggtttgacccc

SEQ ID NO: 5304 - DNA, 18 bp, Artificial Sequence
  Description of Artificial Sequence: Synthetic oligonucleotide
tataattggtttgatcct

SEQ ID NO: 5305 - DNA, 18 bp, Artificial Sequence
  Description of Artificial Sequence: Synthetic oligonucleotide
tattggtattttgatttg

SEQ ID NO: 5306 - DNA, 18 bp, Artificial Sequence
  Description of Artificial Sequence: Synthetic oligonucleotide
tactatgggatggacgtg

SEQ ID NO: 5307 - DNA, 18 bp, Artificial Sequence
  Description of Artificial Sequence: Synthetic oligonucleotide
tactattacatggacgtt

SEQ ID NO: 5308 - DNA, 21 bp, Artificial Sequence
  Description of Artificial Sequence: Synthetic oligonucleotide
tattattacggtatggacgtc

SEQ ID NO: 5309 - DNA, 21 bp, Artificial Sequence
  Description of Artificial Sequence: Synthetic oligonucleotide
tactattattacatggatgtc

SEQ ID NO: 5310 - DNA, 24 bp, Artificial Sequence
  Description of Artificial Sequence: Synthetic oligonucleotide
gactattattacggtatggatgtt

SEQ ID NO: 5311 - DNA, 24 bp, Artificial Sequence
  Description of Artificial Sequence: Synthetic oligonucleotide
ggctactattatggtatggacgtc

SEQ ID NO: 5312 - DNA, 24 bp, Artificial Sequence
  Description of Artificial Sequence: Synthetic oligonucleotide
cattactactatgggatggatgta

SEQ ID NO: 5313 - DNA, 24 bp, Artificial Sequence
  Description of Artificial Sequence: Synthetic oligonucleotide
aactattattattatatggatgtc

SEQ ID NO: 5314 - DNA, 24 bp, Artificial Sequence
  Description of Artificial Sequence: Synthetic oligonucleotide
ccctactactactatatggatgtg

SEQ ID NO: 5315 - DNA, 24 bp, Artificial Sequence
  Description of Artificial Sequence: Synthetic oligonucleotide
aggtattactactacatggacgtc

SEQ ID NO: 5316 - DNA, 24 bp, Artificial Sequence
  Description of Artificial Sequence: Synthetic oligonucleotide
tactattattatgggatggatgta

SEQ ID NO: 5317 - DNA, 27 bp, Artificial Sequence
  Description of Artificial Sequence: Synthetic oligonucleotide
gattactattattacggaatggatgtt

SEQ ID NO: 5318 - DNA, 27 bp, Artificial Sequence
  Description of Artificial Sequence: Synthetic oligonucleotide
gggtattactactacggcatggacgta

SEQ ID NO: 5319 - DNA, 27 bp, Artificial Sequence
  Description of Artificial Sequence: Synthetic oligonucleotide
aattactattactatggcatggatgtg

SEQ ID NO: 5320 - DNA, 27 bp, Artificial Sequence
  Description of Artificial Sequence: Synthetic oligonucleotide
ccatattactattacggcatggatgtc

SEQ ID NO: 5321 - DNA, 27 bp, Artificial Sequence
  Description of Artificial Sequence: Synthetic oligonucleotide
agctactactactacggaatggacgtc

SEQ ID NO: 5322 - DNA, 27 bp, Artificial Sequence
  Description of Artificial Sequence: Synthetic oligonucleotide
tactactactattacggtatggacgta

SEQ ID NO: 5323 - DNA, 30 bp, Artificial Sequence
  Description of Artificial Sequence: Synthetic oligonucleotide
gattattattactactactacatggatgta

SEQ ID NO: 5324 - DNA, 30 bp, Artificial Sequence
  Description of Artificial Sequence: Synthetic oligonucleotide
ggttattattactactatgggatggatgta

SEQ ID NO: 5325 - DNA, 30 bp, Artificial Sequence
  Description of Artificial Sequence: Synthetic oligonucleotide
cactactattattattacgggatggatgta

SEQ ID NO: 5326 - DNA, 30 bp, Artificial Sequence
  Description of Artificial Sequence: Synthetic oligonucleotide
agatactactactattattacatggatgta

SEQ ID NO: 5327 - DNA, 30 bp, Artificial Sequence
  Description of Artificial Sequence: Synthetic oligonucleotide
tattactactattactatggtatggacgtt

SEQ ID NO: 5328 - protein, 4 aa, Artificial Sequence
  Description of Artificial Sequence: Synthetic peptide
AREP

SEQ ID NO: 5329 - protein, 4 aa, Artificial Sequence
  Description of Artificial Sequence: Synthetic peptide
AKEP

SEQ ID NO: 5330 - protein, 4 aa, Artificial Sequence
  Description of Artificial Sequence: Synthetic peptide
AREL

SEQ ID NO: 5331 - protein, 4 aa, Artificial Sequence
  Description of Artificial Sequence: Synthetic peptide
AKEL

SEQ ID NO: 5332 - protein, 5 aa, Artificial Sequence
  Description of Artificial Sequence: Synthetic peptide
AREGR

SEQ ID NO: 5333 - protein, 5 aa, Artificial Sequence
  Description of Artificial Sequence: Synthetic peptide
AKEGR

SEQ ID NO: 5334 - protein, 5 aa, Artificial Sequence
  Description of Artificial Sequence: Synthetic peptide
ARGGR

SEQ ID NO: 5335 - protein, 5 aa, Artificial Sequence
  Description of Artificial Sequence: Synthetic peptide
AKGGR

SEQ ID NO: 5336 - protein, 5 aa, Artificial Sequence
  Description of Artificial Sequence: Synthetic peptide
AREGS

SEQ ID NO: 5337 - protein, 5 aa, Artificial Sequence
  Description of Artificial Sequence: Synthetic peptide
AKEGS

SEQ ID NO: 5338 - protein, 5 aa, Artificial Sequence
  Description of Artificial Sequence: Synthetic peptide
ARDGS

SEQ ID NO: 5339 - protein, 5 aa, Artificial Sequence
  Description of Artificial Sequence: Synthetic peptide
AKDGS

SEQ ID NO: 5340 - protein, 5 aa, Artificial Sequence
  Description of Artificial Sequence: Synthetic peptide
AREGP

SEQ ID NO: 5341 - protein, 5 aa, Artificial Sequence
  Description of Artificial Sequence: Synthetic peptide
AKEGP

SEQ ID NO: 5342 - protein, 5 aa, Artificial Sequence
  Description of Artificial Sequence: Synthetic peptide
ARDGP

SEQ ID NO: 5343 - protein, 5 aa, Artificial Sequence
  Description of Artificial Sequence: Synthetic peptide
AKDGP

SEQ ID NO: 5344 - protein, 5 aa, Artificial Sequence
  Description of Artificial Sequence: Synthetic peptide
AREGL

SEQ ID NO: 5345 - protein, 5 aa, Artificial Sequence
  Description of Artificial Sequence: Synthetic peptide
AKEGL

SEQ ID NO: 5346 - protein, 5 aa, Artificial Sequence
  Description of Artificial Sequence: Synthetic peptide
ARDGL

SEQ ID NO: 5347 - protein, 5 aa, Artificial Sequence
  Description of Artificial Sequence: Synthetic peptide
AKDGL

SEQ ID NO: 5348 - protein, 5 aa, Artificial Sequence
  Description of Artificial Sequence: Synthetic peptide
ARGGL

SEQ ID NO: 5349 - protein, 5 aa, Artificial Sequence
  Description of Artificial Sequence: Synthetic peptide
AKGGL

SEQ ID NO: 5350 - protein, 5 aa, Artificial Sequence
  Description of Artificial Sequence: Synthetic peptide
AREGA

SEQ ID NO: 5351 - protein, 5 aa, Artificial Sequence
  Description of Artificial Sequence: Synthetic peptide
AKEGA

SEQ ID NO: 5352 - protein, 5 aa, Artificial Sequence
  Description of Artificial Sequence: Synthetic peptide
ARDGA

SEQ ID NO: 5353 - protein, 5 aa, Artificial Sequence
  Description of Artificial Sequence: Synthetic peptide
AKDGA

SEQ ID NO: 5354 - protein, 5 aa, Artificial Sequence
  Description of Artificial Sequence: Synthetic peptide
ARDGV

SEQ ID NO: 5355 - protein, 5 aa, Artificial Sequence
  Description of Artificial Sequence: Synthetic peptide
AKDGV

SEQ ID NO: 5356 - protein, 5 aa, Artificial Sequence
  Description of Artificial Sequence: Synthetic peptide
ARESG

SEQ ID NO: 5357 - protein, 5 aa, Artificial Sequence
  Description of Artificial Sequence: Synthetic peptide
AKESG

SEQ ID NO: 5358 - protein, 5 aa, Artificial Sequence
  Description of Artificial Sequence: Synthetic peptide
ARGSG

SEQ ID NO: 5359 - protein, 5 aa, Artificial Sequence
  Description of Artificial Sequence: Synthetic peptide
AKGSG

SEQ ID NO: 5360 - protein, 4 aa, Artificial Sequence
  Description of Artificial Sequence: Synthetic peptide
ARPG

SEQ ID NO: 5361 - protein, 4 aa, Artificial Sequence
  Description of Artificial Sequence: Synthetic peptide
AKPG

SEQ ID NO: 5362 - protein, 5 aa, Artificial Sequence
  Description of Artificial Sequence: Synthetic peptide
ARGPG

SEQ ID NO: 5363 - protein, 5 aa, Artificial Sequence
  Description of Artificial Sequence: Synthetic peptide
AKGPG

SEQ ID NO: 5364 - protein, 5 aa, Artificial Sequence
  Description of Artificial Sequence: Synthetic peptide
ARGLG

SEQ ID NO: 5365 - protein, 5 aa, Artificial Sequence
  Description of Artificial Sequence: Synthetic peptide
AKGLG

SEQ ID NO: 5366 - protein, 5 aa, Artificial Sequence
  Description of Artificial Sequence: Synthetic peptide
AREAG

SEQ ID NO: 5367 - protein, 5 aa, Artificial Sequence
  Description of Artificial Sequence: Synthetic peptide
AKEAG

SEQ ID NO: 5368 - protein, 5 aa, Artificial Sequence
  Description of Artificial Sequence: Synthetic peptide
ARDAG

SEQ ID NO: 5369 - protein, 5 aa, Artificial Sequence
  Description of Artificial Sequence: Synthetic peptide
AKDAG

SEQ ID NO: 5370 - protein, 5 aa, Artificial Sequence
  Description of Artificial Sequence: Synthetic peptide
ARGAG

SEQ ID NO: 5371 - protein, 5 aa, Artificial Sequence
  Description of Artificial Sequence: Synthetic peptide
AKGAG

SEQ ID NO: 5372 - protein, 4 aa, Artificial Sequence
  Description of Artificial Sequence: Synthetic peptide
ARTG

SEQ ID NO: 5373 - protein, 4 aa, Artificial Sequence
  Description of Artificial Sequence: Synthetic peptide
AKTG

SEQ ID NO: 5374 - protein, 5 aa, Artificial Sequence
  Description of Artificial Sequence: Synthetic peptide
ARDTG

SEQ ID NO: 5375 - protein, 5 aa, Artificial Sequence
  Description of Artificial Sequence: Synthetic peptide
AKDTG

SEQ ID NO: 5376 - protein, 5 aa, Artificial Sequence
  Description of Artificial Sequence: Synthetic peptide
AREVG

SEQ ID NO: 5377 - protein, 5 aa, Artificial Sequence
  Description of Artificial Sequence: Synthetic peptide
AKEVG

SEQ ID NO: 5378 - protein, 5 aa, Artificial Sequence
  Description of Artificial Sequence: Synthetic peptide
ARDVG

SEQ ID NO: 5379 - protein, 5 aa, Artificial Sequence
  Description of Artificial Sequence: Synthetic peptide
AKDVG

SEQ ID NO: 5380 - protein, 5 aa, Artificial Sequence
  Description of Artificial Sequence: Synthetic peptide
ARDPR

SEQ ID NO: 5381 - protein, 5 aa, Artificial Sequence
  Description of Artificial Sequence: Synthetic peptide
AKDPR

SEQ ID NO: 5382 - protein, 4 aa, Artificial Sequence
  Description of Artificial Sequence: Synthetic peptide
ARPP

SEQ ID NO: 5383 - protein, 4 aa, Artificial Sequence
  Description of Artificial Sequence: Synthetic peptide
AKPP

SEQ ID NO: 5384 - protein, 5 aa, Artificial Sequence
  Description of Artificial Sequence: Synthetic peptide
ARGPL

SEQ ID NO: 5385 - protein, 5 aa, Artificial Sequence
  Description of Artificial Sequence: Synthetic peptide
AKGPL

SEQ ID NO: 5386 - protein, 4 aa, Artificial Sequence
  Description of Artificial Sequence: Synthetic peptide
ARPA

SEQ ID NO: 5387 - protein, 4 aa, Artificial Sequence
  Description of Artificial Sequence: Synthetic peptide
AKPA

SEQ ID NO: 5388 - protein, 5 aa, Artificial Sequence
  Description of Artificial Sequence: Synthetic peptide
ARDPA

SEQ ID NO: 5389 - protein, 5 aa, Artificial Sequence
  Description of Artificial Sequence: Synthetic peptide
AKDPA

SEQ ID NO: 5390 - protein, 4 aa, Artificial Sequence
  Description of Artificial Sequence: Synthetic peptide
ARPT

SEQ ID NO: 5391 - protein, 4 aa, Artificial Sequence
  Description of Artificial Sequence: Synthetic peptide
AKPT

SEQ ID NO: 5392 - protein, 5 aa, Artificial Sequence
  Description of Artificial Sequence: Synthetic peptide
ARDPT

SEQ ID NO: 5393 - protein, 5 aa, Artificial Sequence
  Description of Artificial Sequence: Synthetic peptide
AKDPT

SEQ ID NO: 5394 - protein, 5 aa, Artificial Sequence
  Description of Artificial Sequence: Synthetic peptide
ARGPT

SEQ ID NO: 5395 - protein, 5 aa, Artificial Sequence
  Description of Artificial Sequence: Synthetic peptide
AKGPT

SEQ ID NO: 5396 - protein, 4 aa, Artificial Sequence
  Description of Artificial Sequence: Synthetic peptide
ARPV

SEQ ID NO: 5397 - protein, 4 aa, Artificial Sequence
  Description of Artificial Sequence: Synthetic peptide
AKPV

SEQ ID NO: 5398 - protein, 5 aa, Artificial Sequence
  Description of Artificial Sequence: Synthetic peptide
ARDPV

SEQ ID NO: 5399 - protein, 5 aa, Artificial Sequence
  Description of Artificial Sequence: Synthetic peptide
AKDPV

SEQ ID NO: 5400 - protein, 5 aa, Artificial Sequence
  Description of Artificial Sequence: Synthetic peptide
ARGRP

SEQ ID NO: 5401 - protein, 5 aa, Artificial Sequence
  Description of Artificial Sequence: Synthetic peptide
AKGRP

SEQ ID NO: 5402 - protein, 5 aa, Artificial Sequence
  Description of Artificial Sequence: Synthetic peptide
ARDSP

SEQ ID NO: 5403 - protein, 5 aa, Artificial Sequence
  Description of Artificial Sequence: Synthetic peptide
AKDSP

SEQ ID NO: 5404 - protein, 5 aa, Artificial Sequence
  Description of Artificial Sequence: Synthetic peptide
ARGSP

SEQ ID NO: 5405 - protein, 5 aa, Artificial Sequence
  Description of Artificial Sequence: Synthetic peptide
AKGSP

SEQ ID NO: 5406 - protein, 5 aa, Artificial Sequence
  Description of Artificial Sequence: Synthetic peptide
ARDLP

SEQ ID NO: 5407 - protein, 5 aa, Artificial Sequence
  Description of Artificial Sequence: Synthetic peptide
AKDLP

SEQ ID NO: 5408 - protein, 5 aa, Artificial Sequence
  Description of Artificial Sequence: Synthetic peptide
ARDAP

SEQ ID NO: 5409 - protein, 5 aa, Artificial Sequence
  Description of Artificial Sequence: Synthetic peptide
AKDAP

SEQ ID NO: 5410 - protein, 5 aa, Artificial Sequence
  Description of Artificial Sequence: Synthetic peptide
ARGAP

SEQ ID NO: 5411 - protein, 5 aa, Artificial Sequence
  Description of Artificial Sequence: Synthetic peptide
AKGAP

SEQ ID NO: 5412 - protein, 5 aa, Artificial Sequence
  Description of Artificial Sequence: Synthetic peptide
ARDTP

SEQ ID NO: 5413 - protein, 5 aa, Artificial Sequence
  Description of Artificial Sequence: Synthetic peptide
AKDTP

SEQ ID NO: 5414 - protein, 5 aa, Artificial Sequence
  Description of Artificial Sequence: Synthetic peptide
ARAGG

SEQ ID NO: 5415 - protein, 5 aa, Artificial Sequence
  Description of Artificial Sequence: Synthetic peptide
AKAGG

SEQ ID NO: 5416 - protein, 6 aa, Artificial Sequence
  Description of Artificial Sequence: Synthetic peptide
ARDGGG

SEQ ID NO: 5417 - protein, 6 aa, Artificial Sequence
  Description of Artificial Sequence: Synthetic peptide
AKDGGG

SEQ ID NO: 5418 - protein, 5 aa, Artificial Sequence
  Description of Artificial Sequence: Synthetic peptide
ARLGG

SEQ ID NO: 5419 - protein, 5 aa, Artificial Sequence
  Description of Artificial Sequence: Synthetic peptide
AKLGG

SEQ ID NO: 5420 - protein, 6 aa, Artificial Sequence
  Description of Artificial Sequence: Synthetic peptide
ARDLGG

SEQ ID NO: 5421 - protein, 6 aa, Artificial Sequence
  Description of Artificial Sequence: Synthetic peptide
AKDLGG

SEQ ID NO: 5422 - protein, 5 aa, Artificial Sequence
  Description of Artificial Sequence: Synthetic peptide
ARRGG

SEQ ID NO: 5423 - protein, 5 aa, Artificial Sequence
  Description of Artificial Sequence: Synthetic peptide
AKRGG

SEQ ID NO: 5424 - protein, 6 aa, Artificial Sequence
  Description of Artificial Sequence: Synthetic peptide
ARDRGG

SEQ ID NO: 5425 - protein, 6 aa, Artificial Sequence
  Description of Artificial Sequence: Synthetic peptide
AKDRGG

SEQ ID NO: 5426 - protein, 5 aa, Artificial Sequence
  Description of Artificial Sequence: Synthetic peptide
ARSGG

SEQ ID NO: 5427 - protein, 5 aa, Artificial Sequence
  Description of Artificial Sequence: Synthetic peptide
AKSGG

SEQ ID NO: 5428 - DNA, 12 bp, Artificial Sequence
  Description of Artificial Sequence: Synthetic oligonucleotide
gccagagagcct

SEQ ID NO: 5429 - DNA, 12 bp, Artificial Sequence
  Description of Artificial Sequence: Synthetic oligonucleotide
gccaaggagcct

SEQ ID NO: 5430 - DNA, 12 bp, Artificial Sequence
  Description of Artificial Sequence: Synthetic oligonucleotide
gccagagagttg

SEQ ID NO: 5431 - DNA, 12 bp, Artificial Sequence
  Description of Artificial Sequence: Synthetic oligonucleotide
gccaaggaattg

SEQ ID NO: 5432 - DNA, 15 bp, Artificial Sequence
  Description of Artificial Sequence: Synthetic oligonucleotide
gccagagaagggaga

SEQ ID NO: 5433 - DNA, 15 bp, Artificial Sequence
  Description of Artificial Sequence: Synthetic oligonucleotide
gccaaggaaggcaga

SEQ ID NO: 5434 - DNA, 15 bp, Artificial Sequence
  Description of Artificial Sequence: Synthetic oligonucleotide
gccagaggaggtaga

SEQ ID NO: 5435 - DNA, 15 bp, Artificial Sequence
  Description of Artificial Sequence: Synthetic oligonucleotide
gccaagggaggtaga

SEQ ID NO: 5436 - DNA, 15 bp, Artificial Sequence
  Description of Artificial Sequence: Synthetic oligonucleotide
gccagagaaggatct

SEQ ID NO: 5437 - DNA, 15 bp, Artificial Sequence
  Description of Artificial Sequence: Synthetic oligonucleotide
gccaaggaaggatct

SEQ ID NO: 5438 - DNA, 15 bp, Artificial Sequence
  Description of Artificial Sequence: Synthetic oligonucleotide
gccagagacggatct

SEQ ID NO: 5439 - DNA, 15 bp, Artificial Sequence
  Description of Artificial Sequence: Synthetic oligonucleotide
gccaaggatggttct

SEQ ID NO: 5440 - DNA, 15 bp, Artificial Sequence
  Description of Artificial Sequence: Synthetic oligonucleotide
gccagagaaggtcct

SEQ ID NO: 5441 - DNA, 15 bp, Artificial Sequence
  Description of Artificial Sequence: Synthetic oligonucleotide
gccaaggaggggcct

SEQ ID NO: 5442 - DNA, 15 bp, Artificial Sequence
  Description of Artificial Sequence: Synthetic oligonucleotide
gccagagacggtcct

SEQ ID NO: 5443 - DNA, 15 bp, Artificial Sequence
  Description of Artificial Sequence: Synthetic oligonucleotide
gccaaggacggtcct

SEQ ID NO: 5444 - DNA, 15 bp, Artificial Sequence
  Description of Artificial Sequence: Synthetic oligonucleotide
gccagagagggcttg

SEQ ID NO: 5445 - DNA, 15 bp, Artificial Sequence
  Description of Artificial Sequence: Synthetic oligonucleotide
gccaaggaagggttg

SEQ ID NO: 5446 - DNA, 15 bp, Artificial Sequence
  Description of Artificial Sequence: Synthetic oligonucleotide
gccagagatgggttg

SEQ ID NO: 5447 - DNA, 15 bp, Artificial Sequence
  Description of Artificial Sequence: Synthetic oligonucleotide
gccaaggacggtttg

SEQ ID NO: 5448 - DNA, 15 bp, Artificial Sequence
  Description of Artificial Sequence: Synthetic oligonucleotide
gccagaggtggattg

SEQ ID NO: 5449 - DNA, 15 bp, Artificial Sequence
  Description of Artificial Sequence: Synthetic oligonucleotide
gccaagggagggttg

SEQ ID NO: 5450 - DNA, 15 bp, Artificial Sequence
  Description of Artificial Sequence: Synthetic oligonucleotide
gccagagaaggagct

SEQ ID NO: 5451 - DNA, 15 bp, Artificial Sequence
  Description of Artificial Sequence: Synthetic oligonucleotide
gccaaggagggagct

SEQ ID NO: 5452 - DNA, 15 bp, Artificial Sequence
  Description of Artificial Sequence: Synthetic oligonucleotide
gccagagatggcgct

SEQ ID NO: 5453 - DNA, 15 bp, Artificial Sequence
  Description of Artificial Sequence: Synthetic oligonucleotide
gccaaggatggagct

SEQ ID NO: 5454 - DNA, 15 bp, Artificial Sequence
  Description of Artificial Sequence: Synthetic oligonucleotide
gccagagatggtgtg

SEQ ID NO: 5455 - DNA, 15 bp, Artificial Sequence
  Description of Artificial Sequence: Synthetic oligonucleotide
gccaaggatggtgtg

SEQ ID NO: 5456 - DNA, 15 bp, Artificial Sequence
  Description of Artificial Sequence: Synthetic oligonucleotide
gccagagagtctgga

SEQ ID NO: 5457 - DNA, 15 bp, Artificial Sequence
  Description of Artificial Sequence: Synthetic oligonucleotide
gccaaggaaagtgga

SEQ ID NO: 5458 - DNA, 15 bp, Artificial Sequence
  Description of Artificial Sequence: Synthetic oligonucleotide
gccagaggctctgga

SEQ ID NO: 5459 - DNA, 15 bp, Artificial Sequence
  Description of Artificial Sequence: Synthetic oligonucleotide
gccaaggggtctgga

SEQ ID NO: 5460 - DNA, 12 bp, Artificial Sequence
  Description of Artificial Sequence: Synthetic oligonucleotide
gccagaccagga

SEQ ID NO: 5461 - DNA, 12 bp, Artificial Sequence
  Description of Artificial Sequence: Synthetic oligonucleotide
gccaagcccgga

SEQ ID NO: 5462 - DNA, 15 bp, Artificial Sequence
  Description of Artificial Sequence: Synthetic oligonucleotide
gccagaggacctgga

SEQ ID NO: 5463 - DNA, 15 bp, Artificial Sequence
  Description of Artificial Sequence: Synthetic oligonucleotide
gccaaggggcctgga

SEQ ID NO: 5464 - DNA, 15 bp, Artificial Sequence
  Description of Artificial Sequence: Synthetic oligonucleotide
gccagaggactagga

SEQ ID NO: 5465 - DNA, 15 bp, Artificial Sequence
  Description of Artificial Sequence: Synthetic oligonucleotide
gccaagggtttggga

SEQ ID NO: 5466 - DNA, 15 bp, Artificial Sequence
  Description of Artificial Sequence: Synthetic oligonucleotide
gccagagaagccgga

SEQ ID NO: 5467 - DNA, 15 bp, Artificial Sequence
  Description of Artificial Sequence: Synthetic oligonucleotide
gccaaggaggctgga

SEQ ID NO: 5468 - DNA, 15 bp, Artificial Sequence
  Description of Artificial Sequence: Synthetic oligonucleotide
gccagagacgcagga

SEQ ID NO: 5469 - DNA, 15 bp, Artificial Sequence
  Description of Artificial Sequence: Synthetic oligonucleotide
gccaaggatgccgga

SEQ ID NO: 5470 - DNA, 15 bp, Artificial Sequence
  Description of Artificial Sequence: Synthetic oligonucleotide
gccagaggtgccgga

SEQ ID NO: 5471 - DNA, 15 bp, Artificial Sequence
  Description of Artificial Sequence: Synthetic oligonucleotide
gccaagggagcagga

SEQ ID NO: 5472 - DNA, 12 bp, Artificial Sequence
  Description of Artificial Sequence: Synthetic oligonucleotide
gccagaactgga

SEQ ID NO: 5473 - DNA, 12 bp, Artificial Sequence
  Description of Artificial Sequence: Synthetic oligonucleotide
gccaagaccgga

SEQ ID NO: 5474 - DNA, 15 bp, Artificial Sequence
  Description of Artificial Sequence: Synthetic oligonucleotide
gccagagacacggga

SEQ ID NO: 5475 - DNA, 15 bp, Artificial Sequence
  Description of Artificial Sequence: Synthetic oligonucleotide
gccaaggatacggga

SEQ ID NO: 5476 - DNA, 15 bp, Artificial Sequence
  Description of Artificial Sequence: Synthetic oligonucleotide
gccagagaagtcgga

SEQ ID NO: 5477 - DNA, 15 bp, Artificial Sequence
  Description of Artificial Sequence: Synthetic oligonucleotide
gccaaggaggtagga

SEQ ID NO: 5478 - DNA, 15 bp, Artificial Sequence
  Description of Artificial Sequence: Synthetic oligonucleotide
gccagagatgtagga

SEQ ID NO: 5479 - DNA, 15 bp, Artificial Sequence
  Description of Artificial Sequence: Synthetic oligonucleotide
gccaaggacgtagga

SEQ ID NO: 5480 - DNA, 15 bp, Artificial Sequence
  Description of Artificial Sequence: Synthetic oligonucleotide
gccagagatccaaga

SEQ ID NO: 5481 - DNA, 15 bp, Artificial Sequence
  Description of Artificial Sequence: Synthetic oligonucleotide
gccaaggatcctaga

SEQ ID NO: 5482 - DNA, 12 bp, Artificial Sequence
  Description of Artificial Sequence: Synthetic oligonucleotide
gccagaccacct

SEQ ID NO: 5483 - DNA, 12 bp, Artificial Sequence
  Description of Artificial Sequence: Synthetic oligonucleotide
gccaagccacct

SEQ ID NO: 5484 - DNA, 15 bp, Artificial Sequence
  Description of Artificial Sequence: Synthetic oligonucleotide
gccagaggtcccttg

SEQ ID NO: 5485 - DNA, 15 bp, Artificial Sequence
  Description of Artificial Sequence: Synthetic oligonucleotide
gccaaggggccgttg

SEQ ID NO: 5486 - DNA, 12 bp, Artificial Sequence
  Description of Artificial Sequence: Synthetic oligonucleotide
gccagaccagct

SEQ ID NO: 5487 - DNA, 12 bp, Artificial Sequence
  Description of Artificial Sequence: Synthetic oligonucleotide
gccaagccggct

SEQ ID NO: 5488 - DNA, 15 bp, Artificial Sequence
  Description of Artificial Sequence: Synthetic oligonucleotide
gccagagatcccgct

SEQ ID NO: 5489 - DNA, 15 bp, Artificial Sequence
  Description of Artificial Sequence: Synthetic oligonucleotide
gccaaggaccccgct

SEQ ID NO: 5490 - DNA, 12 bp, Artificial Sequence
  Description of Artificial Sequence: Synthetic oligonucleotide
gccagacctact

SEQ ID NO: 5491 - DNA, 12 bp, Artificial Sequence
  Description of Artificial Sequence: Synthetic oligonucleotide
gccaagcctact

SEQ ID NO: 5492 - DNA, 15 bp, Artificial Sequence
  Description of Artificial Sequence: Synthetic oligonucleotide
gccagagatccgact

SEQ ID NO: 5493 - DNA, 15 bp, Artificial Sequence
  Description of Artificial Sequence: Synthetic oligonucleotide
gccaaggaccctact

SEQ ID NO: 5494 - DNA, 15 bp, Artificial Sequence
  Description of Artificial Sequence: Synthetic oligonucleotide
gccagaggacccact

SEQ ID NO: 5495 - DNA, 15 bp, Artificial Sequence
  Description of Artificial Sequence: Synthetic oligonucleotide
gccaaggggcccact

SEQ ID NO: 5496 - DNA, 12 bp, Artificial Sequence
  Description of Artificial Sequence: Synthetic oligonucleotide
gccagaccggtg

SEQ ID NO: 5497 - DNA, 12 bp, Artificial Sequence
  Description of Artificial Sequence: Synthetic oligonucleotide
gccaagccagtg

SEQ ID NO: 5498 - DNA, 15 bp, Artificial Sequence
  Description of Artificial Sequence: Synthetic oligonucleotide
gccagagatccggtg

SEQ ID NO: 5499 - DNA, 15 bp, Artificial Sequence
  Description of Artificial Sequence: Synthetic oligonucleotide
gccaaggaccctgtg

SEQ ID NO: 5500 - DNA, 15 bp, Artificial Sequence
  Description of Artificial Sequence: Synthetic oligonucleotide
gccagaggaaggcct

SEQ ID NO: 5501 - DNA, 15 bp, Artificial Sequence
  Description of Artificial Sequence: Synthetic oligonucleotide
gccaagggccgtcct

SEQ ID NO: 5502 - DNA, 15 bp, Artificial Sequence
  Description of Artificial Sequence: Synthetic oligonucleotide
gccagagactctcct

SEQ ID NO: 5503 - DNA, 15 bp, Artificial Sequence
  Description of Artificial Sequence: Synthetic oligonucleotide
gccaaggactcccct

SEQ ID NO: 5504 - DNA, 15 bp, Artificial Sequence
  Description of Artificial Sequence: Synthetic oligonucleotide
gccagaggttcccct

SEQ ID NO: 5505 - DNA, 15 bp, Artificial Sequence
  Description of Artificial Sequence: Synthetic oligonucleotide
gccaagggttcacct

SEQ ID NO: 5506 - DNA, 15 bp, Artificial Sequence
  Description of Artificial Sequence: Synthetic oligonucleotide
gccagagatcttcct

SEQ ID NO: 5507 - DNA, 15 bp, Artificial Sequence
  Description of Artificial Sequence: Synthetic oligonucleotide
gccaaggatctacct

SEQ ID NO: 5508 - DNA, 15 bp, Artificial Sequence
  Description of Artificial Sequence: Synthetic oligonucleotide
gccagagatgctcct

SEQ ID NO: 5509 - DNA, 15 bp, Artificial Sequence
  Description of Artificial Sequence: Synthetic oligonucleotide
gccaaggatgctcct

SEQ ID NO: 5510 - DNA, 15 bp, Artificial Sequence
  Description of Artificial Sequence: Synthetic oligonucleotide
gccagaggggcccct

SEQ ID NO: 5511 - DNA, 15 bp, Artificial Sequence
  Description of Artificial Sequence: Synthetic oligonucleotide
gccaagggtgcccct

SEQ ID NO: 5512 - DNA, 15 bp, Artificial Sequence
  Description of Artificial Sequence: Synthetic oligonucleotide
gccagagatacccct

SEQ ID NO: 5513 - DNA, 15 bp, Artificial Sequence
  Description of Artificial Sequence: Synthetic oligonucleotide
gccaaggacacgcct

SEQ ID NO: 5514 - DNA, 15 bp, Artificial Sequence
  Description of Artificial Sequence: Synthetic oligonucleotide
gccagagctggcgga

SEQ ID NO: 5515 - DNA, 15 bp, Artificial Sequence
  Description of Artificial Sequence: Synthetic oligonucleotide
gccaaggccggtgga

SEQ ID NO: 5516 - DNA, 18 bp, Artificial Sequence
  Description of Artificial Sequence: Synthetic oligonucleotide
gccagagatggtggcgga

SEQ ID NO: 5517 - DNA, 18 bp, Artificial Sequence
  Description of Artificial Sequence: Synthetic oligonucleotide
gccaaggacggcggtgga

SEQ ID NO: 5518 - DNA, 15 bp, Artificial Sequence
  Description of Artificial Sequence: Synthetic oligonucleotide
gccagattgggcgga

SEQ ID NO: 5519 - DNA, 15 bp, Artificial Sequence
  Description of Artificial Sequence: Synthetic oligonucleotide
gccaagctaggcgga

SEQ ID NO: 5520 - DNA, 18 bp, Artificial Sequence
  Description of Artificial Sequence: Synthetic oligonucleotide
gccagagatttgggtgga

SEQ ID NO: 5521 - DNA, 18 bp, Artificial Sequence
  Description of Artificial Sequence: Synthetic oligonucleotide
gccaaggatttgggtgga

SEQ ID NO: 5522 - DNA, 15 bp, Artificial Sequence
  Description of Artificial Sequence: Synthetic oligonucleotide
gccagaagaggtgga

SEQ ID NO: 5523 - DNA, 15 bp, Artificial Sequence
  Description of Artificial Sequence: Synthetic oligonucleotide
gccaagagaggagga

SEQ ID NO: 5524 - DNA, 18 bp, Artificial Sequence
  Description of Artificial Sequence: Synthetic oligonucleotide
gccagagaccgtggcgga

SEQ ID NO: 5525 - DNA, 18 bp, Artificial Sequence
  Description of Artificial Sequence: Synthetic oligonucleotide
gccaaggacagaggtgga

SEQ ID NO: 5526 - DNA, 15 bp, Artificial Sequence
  Description of Artificial Sequence: Synthetic oligonucleotide
gccagatcaggcgga

SEQ ID NO: 5527 - DNA, 15 bp, Artificial Sequence
  Description of Artificial Sequence: Synthetic oligonucleotide
gccaagtccggtgga

SEQ ID NO: 5528 - DNA, 12 bp, Artificial Sequence
  Description of Artificial Sequence: Synthetic oligonucleotide
bhcacagccaks

SEQ ID NO: 5529 - DNA, 12 bp, Artificial Sequence
  Description of Artificial Sequence: Synthetic oligonucleotide
vhggbagcaact

SEQ ID NO: 5530 - DNA, 12 bp, Artificial Sequence
  Description of Artificial Sequence: Synthetic oligonucleotide
  modified_base (11)..(11): a, c, t or g
  misc_feature (11)..(11): n is a, c, g, or t
dbgttcggagng

SEQ ID NO: 5531 - DNA, 12 bp, Artificial Sequence
  Description of Artificial Sequence: Synthetic oligonucleotide
bhcggakmctat

SEQ ID NO: 5532 - DNA, 12 bp, Artificial Sequence
  Description of Artificial Sequence: Synthetic oligonucleotide
tacagcagcvbt

SEQ ID NO: 5533 - DNA, 12 bp, Artificial Sequence
  Description of Artificial Sequence: Synthetic oligonucleotide
vhggtarsaggt

SEQ ID NO: 5534 - DNA, 12 bp, Artificial Sequence
  Description of Artificial Sequence: Synthetic oligonucleotide
vbcgacggatht

SEQ ID NO: 5535 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhctacggagvt

SEQ ID NO: 5536 - DNA, 12 bp, Artificial Sequence
  Description of Artificial Sequence: Synthetic oligonucleotide
vhgryggcaact

SEQ ID NO: 5537 - DNA, 12 bp, Artificial Sequence
  Description of Artificial Sequence: Synthetic oligonucleotide
vhatacagcrst

SEQ ID NO: 5538 - DNA, 12 bp, Artificial Sequence
  Description of Artificial Sequence: Synthetic oligonucleotide
cagtggctabht

SEQ ID NO: 5539 - DNA, 12 bp, Artificial Sequence
  Description of Artificial Sequence: Synthetic oligonucleotide
  modified_base (11)..(11): a, c, t or g
  misc_feature (11)..(11): n is a, c, g, or t
vhagtagcagnt

SEQ ID NO: 5540 - DNA, 12 bp, Artificial Sequence
  Description of Artificial Sequence: Synthetic oligonucleotide
vbcacagtarmg

SEQ ID NO: 5541 - DNA, 12 bp, Artificial Sequence
  Description of Artificial Sequence: Synthetic oligonucleotide
agcagcagcdbg

SEQ ID NO: 5542 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhctmctacggt

SEQ ID NO: 5543 - DNA, 12 bp, Artificial Sequence
  Description of Artificial Sequence: Synthetic oligonucleotide
bhcagctggtht

SEQ ID NO: 5544 - DNA, 12 bp, Artificial Sequence
  Description of Artificial Sequence: Synthetic oligonucleotide
  modified_base (11)..(11): a, c, t or g
  misc_feature (11)..(11): n is a, c, g, or t
vhacaactagnt

SEQ ID NO: 5545 - DNA, 12 bp, Artificial Sequence
  Description of Artificial Sequence: Synthetic oligonucleotide
bhcggaagckmt

SEQ ID NO: 5546 - DNA, 12 bp, Artificial Sequence
  Description of Artificial Sequence: Synthetic oligonucleotide
bhcggatsgtat

SEQ ID NO: 5547 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhcagcggabgg

SEQ ID NO: 5548 - DNA, 12 bp, Artificial Sequence
  Description of Artificial Sequence: Synthetic oligonucleotide
bhcggatackmt

SEQ ID NO: 5549 - DNA, 12 bp, Artificial Sequence
  Description of Artificial Sequence: Synthetic oligonucleotide
vhagtaacarmg

SEQ ID NO: 5550 - DNA, 12 bp, Artificial Sequence
  Description of Artificial Sequence: Synthetic oligonucleotide
gcagcagcavbt

SEQ ID NO: 5551 - DNA, 12 bp, Artificial Sequence
  Description of Artificial Sequence: Synthetic oligonucleotide
vbcayattcggt

SEQ ID NO: 5552 - DNA, 12 bp, Artificial Sequence
  Description of Artificial Sequence: Synthetic oligonucleotide
gtagcagcavha

SEQ ID NO: 5553 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhctactacgvt

SEQ ID NO: 5554 - DNA, 12 bp, Artificial Sequence
  Description of Artificial Sequence: Synthetic oligonucleotide
vbckmcggatat

SEQ ID NO: 5555 - DNA, 12 bp, Artificial Sequence
  Description of Artificial Sequence: Synthetic oligonucleotide
vhacaactakkg

SEQ ID NO: 5556 - DNA, 12 bp, Artificial Sequence
  Description of Artificial Sequence: Synthetic oligonucleotide
vhgggarkcgct

SEQ ID NO: 5557 - DNA, 12 bp, Artificial Sequence
  Description of Artificial Sequence: Synthetic oligonucleotide
vbtbtcggagag

SEQ ID NO: 5558 - DNA, 12 bp, Artificial Sequence
  Description of Artificial Sequence: Synthetic oligonucleotide
bhctacagckmt

SEQ ID NO: 5559 - DNA, 12 bp, Artificial Sequence
  Description of Artificial Sequence: Synthetic oligonucleotide
vhagtassagct

SEQ ID NO: 5560 - DNA, 12 bp, Artificial Sequence
  Description of Artificial Sequence: Synthetic oligonucleotide
vbtcdaggagtt

SEQ ID NO: 5561 - DNA, 12 bp, Artificial Sequence
  Description of Artificial Sequence: Synthetic oligonucleotide
gacagcagcdbg

SEQ ID NO: 5562 - DNA, 12 bp, Artificial Sequence
  Description of Artificial Sequence: Synthetic oligonucleotide
vbcgvctacagt

SEQ ID NO: 5563 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhctacggakct

SEQ ID NO: 5564 - DNA, 12 bp, Artificial Sequence
  Description of Artificial Sequence: Synthetic oligonucleotide
  modified_base (1)..(1): a, c, t or g
  misc_feature (1)..(1): n is a, c, g, or t
nhctactactht

SEQ ID NO: 5565 - DNA, 12 bp, Artificial Sequence
  Description of Artificial Sequence: Synthetic oligonucleotide
bhcvgctacagt

SEQ ID NO: 5566 - DNA, 12 bp, Artificial Sequence
  Description of Artificial Sequence: Synthetic oligonucleotide
vbctggttcggt

SEQ ID NO: 5567 - DNA, 12 bp, Artificial Sequence
  Description of Artificial Sequence: Synthetic oligonucleotide
  modified_base (2)..(2): a, c, t or g
  misc_feature (2)..(2): n is a, c, g, or t
vnctactactht

SEQ ID NO: 5568 - DNA, 12 bp, Artificial Sequence
  Description of Artificial Sequence: Synthetic oligonucleotide
vhabtcggaggt

SEQ ID NO: 5569 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhcatggtaagagvt

SEQ ID NO: 5570 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhctacggagactht

SEQ ID NO: 5571 - DNA, 15 bp, Artificial Sequence
  Description of Artificial Sequence: Synthetic oligonucleotide
  modified_base (14)..(14): a, c, t or g
  misc_feature (14)..(14): n is a, c, g, or t
vbctacagctacgnt

SEQ ID NO: 5572 - DNA, 15 bp, Artificial Sequence
  Description of Artificial Sequence: Synthetic oligonucleotide
  modified_base (2)..(2): a, c, t or g
  misc_feature (2)..(2): n is a, c, g, or t
vncagcggaagctht

SEQ ID NO: 5573 - DNA, 15 bp, Artificial Sequence
  Description of Artificial Sequence: Synthetic oligonucleotide
vbctttctagaatbg

SEQ ID NO: 5574 - DNA, 15 bp, Artificial Sequence
  Description of Artificial Sequence: Synthetic oligonucleotide
bhcggaagctackmt

SEQ ID NO: 5575 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhcagcggaagctht

SEQ ID NO: 5576 - DNA, 15 bp, Artificial Sequence
  Description of Artificial Sequence: Synthetic oligonucleotide
bhcagcagcagctbg

SEQ ID NO: 5577 - DNA, 15 bp, Artificial Sequence
  Description of Artificial Sequence: Synthetic oligonucleotide
bhcagcagcggatbg

SEQ ID NO: 5578 - DNA, 15 bp, Artificial Sequence
  Description of Artificial Sequence: Synthetic oligonucleotide
  modified_base (14)..(14): a, c, t or g
  misc_feature (14)..(14): n is a, c, g, or t
vbcacagtaacaana

SEQ ID NO: 5579 - DNA, 15 bp, Artificial Sequence
  Description of Artificial Sequence: Synthetic oligonucleotide
bhcagcagcagctht

SEQ ID NO: 5580 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhcagcggatggtht

SEQ ID NO: 5581 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhcagcggatacgvt

SEQ ID NO: 5582 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacabt

SEQ ID NO: 5583 - DNA, 15 bp, Artificial Sequence
  Description of Artificial Sequence: Synthetic oligonucleotide
bhcagcagcggatht

SEQ ID NO: 5584 - DNA, 15 bp, Artificial Sequence
  Description of Artificial Sequence: Synthetic oligonucleotide
  modified_base (14)..(14): a, c, t or g
  misc_feature (14)..(14): n is a, c, g, or t
vhagcagcaagacnt

SEQ ID NO: 5585 - DNA, 15 bp, Artificial Sequence
  Description of Artificial Sequence: Synthetic oligonucleotide
vhgtactactacgvt

SEQ ID NO: 5586 - DNA, 15 bp, Artificial Sequence
  Description of Artificial Sequence: Synthetic oligonucleotide
vbcacaatggtacrg

SEQ ID NO: 5587 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhcatggtacraggt

SEQ ID NO: 5588 - DNA, 15 bp, Artificial Sequence
  Description of Artificial Sequence: Synthetic oligonucleotide
  modified_base (1)..(1): a, c, t or g
  misc_feature (1)..(1): n is a, c, g, or t
nhctsgggaagctat

SEQ ID NO: 5589 - DNA, 18 bp, Artificial Sequence
  Description of Artificial Sequence: Synthetic oligonucleotide
bhcagcagcagctggtht

SEQ ID NO: 5590 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacagcabt

SEQ ID NO: 5591 - DNA, 18 bp, Artificial Sequence
  Description of Artificial Sequence: Synthetic oligonucleotide
  modified_base (17)..(17): a, c, t or g
  misc_feature (17)..(17): n is a, c, g, or t
vbctacagcggatacgnt

SEQ ID NO: 5592 - DNA, 18 bp, Artificial Sequence
  Description of Artificial Sequence: Synthetic oligonucleotide
bhcagcagcggatggtht

SEQ ID NO: 5593 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhctactacggaagcgvt

SEQ ID NO: 5594 - DNA, 18 bp, Artificial Sequence
  Description of Artificial Sequence: Synthetic oligonucleotide
bhcagcagcggatactht

SEQ ID NO: 5595 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhctacgacagcagcgvt

SEQ ID NO: 5596 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhcgacttctggagcgvt

SEQ ID NO: 5597 - DNA, 18 bp, Artificial Sequence
  Description of Artificial Sequence: Synthetic oligonucleotide
bhcgacagcagcggatht

SEQ ID NO: 5598 - DNA, 18 bp, Artificial Sequence
  Description of Artificial Sequence: Synthetic oligonucleotide
  modified_base (2)..(2): a, c, t or g
  misc_feature (2)..(2): n is a, c, g, or t
snatacttcgactggyyt

SEQ ID NO: 5599 - DNA, 18 bp, Artificial Sequence
  Description of Artificial Sequence: Synthetic oligonucleotide
tgtrgcrgcacaagctgt

SEQ ID NO: 5600 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhctactacggaagcgvg

SEQ ID NO: 5601 - DNA, 18 bp, Artificial Sequence
  Description of Artificial Sequence: Synthetic oligonucleotide
tgtrgcrgcggaagctgt

SEQ ID NO: 5602 - DNA, 18 bp, Artificial Sequence
  Description of Artificial Sequence: Synthetic oligonucleotide
  modified_base (1)..(1): a, c, t or g
  misc_feature (1)..(1): n is a, c, g, or t
nhcttttggagcggatht

SEQ ID NO: 5603 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacagcagcgvt

SEQ ID NO: 5604 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhcgacatactaacaggatht

SEQ ID NO: 5605 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhctacgacttctggagcgvt

SEQ ID NO: 5606 - DNA, 21 bp, Artificial Sequence
  Description of Artificial Sequence: Synthetic oligonucleotide
bhctgtagcagcacaagctgt

SEQ ID NO: 5607 - DNA, 21 bp, Artificial Sequence
  Description of Artificial Sequence: Synthetic oligonucleotide
dbgtacagcagcagctggtht

SEQ ID NO: 5608 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhctacgacagcagcggatht

SEQ ID NO: 5609 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhctactacggaagcggaabt

SEQ ID NO: 5610 - DNA, 21 bp, Artificial Sequence
  Description of Artificial Sequence: Synthetic oligonucleotide
dbgtacagcagcggatggtht

SEQ ID NO: 5611 - DNA, 21 bp, Artificial Sequence
  Description of Artificial Sequence: Synthetic oligonucleotide
bhctgtagcggaggaagctgt

SEQ ID NO: 5612 - DNA, 21 bp, Artificial Sequence
  Description of Artificial Sequence: Synthetic oligonucleotide
tgtagcggaggaagctgtyht

SEQ ID NO: 5613 - DNA, 21 bp, Artificial Sequence
  Description of Artificial Sequence: Synthetic oligonucleotide
tgtagcagcacaagctgtyht

SEQ ID NO: 5614 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhctgtggaggagactgttht

SEQ ID NO: 5615 - DNA, 21 bp, Artificial Sequence
  Description of Artificial Sequence: Synthetic oligonucleotide
  modified_base (1)..(1): a, c, t or g
  misc_feature (1)..(1): n is a, c, g, or t
nhcgacttctggagcggatht

SEQ ID NO: 5616 - DNA, 21 bp, Artificial Sequence
  Description of Artificial Sequence: Synthetic oligonucleotide
bhcgacagcagcggatactht

SEQ ID NO: 5617 - DNA, 21 bp, Artificial Sequence
  Description of Artificial Sequence: Synthetic oligonucleotide
vhatactgtggaggagactgt

SEQ ID NO: 5618 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacagcagcggatht

SEQ ID NO: 5619 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhctactacggaagcggaagctht

SEQ ID NO: 5620 - DNA, 24 bp, Artificial Sequence
  Description of Artificial Sequence: Synthetic oligonucleotide
vbctactgtagcagcacaagctgt

SEQ ID NO: 5621 - DNA, 24 bp, Artificial Sequence
  Description of Artificial Sequence: Synthetic oligonucleotide
vbctactgtagcggaggaagctgt

SEQ ID NO: 5622 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhctacgacttctggagcggatht

SEQ ID NO: 5623 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhcgacatactaacaggatactht

SEQ ID NO: 5624 - DNA, 24 bp, Artificial Sequence
  Description of Artificial Sequence: Synthetic oligonucleotide
bhctgtagcggaggaagctgttht

SEQ ID NO: 5625 - DNA, 24 bp, Artificial Sequence
  Description of Artificial Sequence: Synthetic oligonucleotide
bhctgtagcagcacaagctgttht

SEQ ID NO: 5626 - DNA, 24 bp, Artificial Sequence
  Description of Artificial Sequence: Synthetic oligonucleotide
vhatactgtggaggagactgttht

SEQ ID NO: 5627 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhctacgacagcagcggatactht

SEQ ID NO: 5628 - DNA, 24 bp, Artificial Sequence
  Description of Artificial Sequence: Synthetic oligonucleotide
  modified_base (2)..(2): a, c, t or g
  misc_feature (2)..(2): n is a, c, g, or t
vnctactacggaagcggaagctmt

SEQ ID NO: 5629 - DNA, 24 bp, Artificial Sequence
  Description of Artificial Sequence: Synthetic oligonucleotide
  modified_base (1)..(1): a, c, t or g
  misc_feature (1)..(1): n is a, c, g, or t
nhcgacttctggagcggatactht

SEQ ID NO: 5630 - DNA, 24 bp, Artificial Sequence
  Description of Artificial Sequence: Synthetic oligonucleotide
vhactaagatacttcgactggywt

SEQ ID NO: 5631 - DNA, 27 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacagcagcggatactht

SEQ ID NO: 5632 - DNA, 27 bp, Artificial Sequence
  Description of Artificial Sequence: Synthetic oligonucleotide
vbctactgtagcggaggaagctgttht

SEQ ID NO: 5633 - DNA, 27 bp, Artificial Sequence
  Description of Artificial Sequence: Synthetic oligonucleotide
vbctactgtagcagcacaagctgttht

SEQ ID NO: 5634 - DNA, 27 bp, Artificial Sequence
  Description of Artificial Sequence: Synthetic oligonucleotide
  modified_base (1)..(1): a, c, t or g
  misc_feature (1)..(1): n is a, c, g, or t
nhctacgacttctggagcggatactht

SEQ ID NO: 5635 - DNA, 27 bp, Artificial Sequence
  Description of Artificial Sequence: Synthetic oligonucleotide
bhctgtagcggaggaagctgttactht

SEQ ID NO: 5636 - DNA, 30 bp, Artificial Sequence
  Description of Artificial Sequence: Synthetic oligonucleotide
  modified_base (1)..(1): a, c, t or g
  misc_feature (1)..(1): n is a, c, g, or t
nhctactacgacagcagcggatactactht

SEQ ID NO: 5637 - DNA, 33 bp, Artificial Sequence
  Description of Artificial Sequence: Synthetic oligonucleotide
  modified_base (1)..(1): a, c, t or g
  misc_feature (1)..(1): n is a, c, g, or t
nhctacgactacgtatggggaagctacgcatht

SEQ ID NO: 5638 - DNA, 36 bp, Artificial Sequence
  Description of Artificial Sequence: Synthetic oligonucleotide
  modified_base (1)..(1): a, c, t or g
  misc_feature (1)..(1): n is a, c, g, or t
nhctacgactacgtatggggaagctacgcatacaha

SEQ ID NO: 5639 - protein, 4 aa, Artificial Sequence
  Description of Artificial Sequence: Synthetic peptide
YTAM

SEQ ID NO: 5640 - protein, 4 aa, Artificial Sequence
  Description of Artificial Sequence: Synthetic peptide
HTAI

SEQ ID NO: 5641 - protein, 4 aa, Artificial Sequence
  Description of Artificial Sequence: Synthetic peptide
YTAS

SEQ ID NO: 5642 - protein, 4 aa, Artificial Sequence
  Description of Artificial Sequence: Synthetic peptide
YTAI

SEQ ID NO: 5643 - protein, 4 aa, Artificial Sequence
  Description of Artificial Sequence: Synthetic peptide
YTAR

SEQ ID NO: 5644 - protein, 4 aa, Artificial Sequence
  Description of Artificial Sequence: Synthetic peptide
PTAS

SEQ ID NO: 5645 - protein, 4 aa, Artificial Sequence
  Description of Artificial Sequence: Synthetic peptide
LTAM

SEQ ID NO: 5646 - protein, 4 aa, Artificial Sequence
  Description of Artificial Sequence: Synthetic peptide
DTAI

SEQ ID NO: 5647 - protein, 4 aa, Artificial Sequence
  Description of Artificial Sequence: Synthetic peptide
FTAS

SEQ ID NO: 5648 - protein, 4 aa, Artificial Sequence
  Description of Artificial Sequence: Synthetic peptide
FTAM

SEQ ID NO: 5649 - protein, 4 aa, Artificial Sequence
  Description of Artificial Sequence: Synthetic peptide
LTAS

SEQ ID NO: 5650 - protein, 4 aa, Artificial Sequence
  Description of Artificial Sequence: Synthetic peptide
ATAI

SEQ ID NO: 5651 - protein, 4 aa, Artificial Sequence
  Description of Artificial Sequence: Synthetic peptide
STAI

SEQ ID NO: 5652 - protein, 4 aa, Artificial Sequence
  Description of Artificial Sequence: Synthetic peptide
FTAR

SEQ ID NO: 5653 - protein, 4 aa, Artificial Sequence
  Description of Artificial Sequence: Synthetic peptide
STAR

SEQ ID NO: 5654 - protein, 4 aa, Artificial Sequence
  Description of Artificial Sequence: Synthetic peptide
LTAR

SEQ ID NO: 5655 - protein, 4 aa, Artificial Sequence
  Description of Artificial Sequence: Synthetic peptide
FTAI

SEQ ID NO: 5656 - protein, 4 aa, Artificial Sequence
  Description of Artificial Sequence: Synthetic peptide
LTAI

SEQ ID NO: 5657 - protein, 4 aa, Artificial Sequence
  Description of Artificial Sequence: Synthetic peptide
STAM

SEQ ID NO: 5658 - protein, 4 aa, Artificial Sequence
  Description of Artificial Sequence: Synthetic peptide
ATAM

SEQ ID NO: 5659 - protein, 4 aa, Artificial Sequence
  Description of Artificial Sequence: Synthetic peptide
STAS

SEQ ID NO: 5660 - protein, 4 aa, Artificial Sequence
  Description of Artificial Sequence: Synthetic peptide
ATAR

SEQ ID NO: 5661 - protein, 4 aa, Artificial Sequence
  Description of Artificial Sequence: Synthetic peptide
HTAS

SEQ ID NO: 5662 - protein, 4 aa, Artificial Sequence
  Description of Artificial Sequence: Synthetic peptide
HTAM

SEQ ID NO: 5663 - protein, 4 aa, Artificial Sequence
  Description of Artificial Sequence: Synthetic peptide
DTAR

SEQ ID NO: 5664 - protein, 4 aa, Artificial Sequence
  Description of Artificial Sequence: Synthetic peptide
HTAR

SEQ ID NO: 5665 - protein, 4 aa, Artificial Sequence
  Description of Artificial Sequence: Synthetic peptide
ATAS

SEQ ID NO: 5666 - protein, 4 aa, Artificial Sequence
  Description of Artificial Sequence: Synthetic peptide
VTAM

SEQ ID NO: 5667 - protein, 4 aa, Artificial Sequence
  Description of Artificial Sequence: Synthetic peptide
PTAR

SEQ ID NO: 5668 - protein, 4 aa, Artificial Sequence
  Description of Artificial Sequence: Synthetic peptide
DTAS

SEQ ID NO: 5669 - protein, 4 aa, Artificial Sequence
  Description of Artificial Sequence: Synthetic peptide
VTAS

SEQ ID NO: 5670 - protein, 4 aa, Artificial Sequence
  Description of Artificial Sequence: Synthetic peptide
PTAM

SEQ ID NO: 5671 - protein, 4 aa, Artificial Sequence
  Description of Artificial Sequence: Synthetic peptide
VTAR

SEQ ID NO: 5672 - protein, 4 aa, Artificial Sequence
  Description of Artificial Sequence: Synthetic peptide
PTAI

SEQ ID NO: 5673 - protein, 4 aa, Artificial Sequence
  Description of Artificial Sequence: Synthetic peptide
LVAT

SEQ ID NO: 5674 - protein, 4 aa, Artificial Sequence
  Description of Artificial Sequence: Synthetic peptide
LAAT

SEQ ID NO: 5675 - protein, 4 aa, Artificial Sequence
  Description of Artificial Sequence: Synthetic peptide
MVAT

SEQ ID NO: 5676 - protein, 4 aa, Artificial Sequence
  Description of Artificial Sequence: Synthetic peptide
TGAT

SEQ ID NO: 5677 - protein, 4 aa, Artificial Sequence
  Description of Artificial Sequence: Synthetic peptide
AVAT

SEQ ID NO: 5678 - protein, 4 aa, Artificial Sequence
  Description of Artificial Sequence: Synthetic peptide
PAAT

SEQ ID NO: 5679 - protein, 4 aa, Artificial Sequence
  Description of Artificial Sequence: Synthetic peptide
KGAT

SEQ ID NO: 5680 - protein, 4 aa, Artificial Sequence
  Description of Artificial Sequence: Synthetic peptide
EGAT

SEQ ID NO: 5681 - protein, 4 aa, Artificial Sequence
  Description of Artificial Sequence: Synthetic peptide
PVAT

SEQ ID NO: 5682 - protein, 4 aa, Artificial Sequence
  Description of Artificial Sequence: Synthetic peptide
AGAT

SEQ ID NO: 5683 - protein, 4 aa, Artificial Sequence
  Description of Artificial Sequence: Synthetic peptide
QAAT

SEQ ID NO: 5684 - protein, 4 aa, Artificial Sequence
  Description of Artificial Sequence: Synthetic peptide
AAAT

SEQ ID NO: 5685 - protein, 4 aa, Artificial Sequence
  Description of Artificial Sequence: Synthetic peptide
VVAT

SEQ ID NO: 5686 - protein, 4 aa, Artificial Sequence
  Description of Artificial Sequence: Synthetic peptide
TVAT

SEQ ID NO: 5687 - protein, 4 aa, Artificial Sequence
  Description of Artificial Sequence: Synthetic peptide
EVAT

SEQ ID NO: 5688 - protein, 4 aa, Artificial Sequence
  Description of Artificial Sequence: Synthetic peptide
LGAT

SEQ ID NO: 5689 - protein, 4 aa, Artificial Sequence
  Description of Artificial Sequence: Synthetic peptide
KAAT

SEQ ID NO: 5690 - protein, 4 aa, Artificial Sequence
  Description of Artificial Sequence: Synthetic peptide
MGAT

SEQ ID NO: 5691 - protein, 4 aa, Artificial Sequence
  Description of Artificial Sequence: Synthetic peptide
PGAT

SEQ ID NO: 5692 - protein, 4 aa, Artificial Sequence
  Description of Artificial Sequence: Synthetic peptide
QVAT

SEQ ID NO: 5693 - protein, 4 aa, Artificial Sequence
  Description of Artificial Sequence: Synthetic peptide
KVAT

SEQ ID NO: 5694 - protein, 4 aa, Artificial Sequence
  Description of Artificial Sequence: Synthetic peptide
EAAT

SEQ ID NO: 5695 - protein, 4 aa, Artificial Sequence
  Description of Artificial Sequence: Synthetic peptide
TAAT

SEQ ID NO: 5696 - protein, 4 aa, Artificial Sequence
  Description of Artificial Sequence: Synthetic peptide
MAAT

SEQ ID NO: 5697 - protein, 4 aa, Artificial Sequence
  Description of Artificial Sequence: Synthetic peptide
QGAT

SEQ ID NO: 5698 - protein, 4 aa, Artificial Sequence
  Description of Artificial Sequence: Synthetic peptide
RFGA

SEQ ID NO: 5699 - protein, 4 aa, Artificial Sequence
  Description of Artificial Sequence: Synthetic peptide
MFGE

SEQ ID NO: 5700 - protein, 4 aa, Artificial Sequence
  Description of Artificial Sequence: Synthetic peptide
MFGA

SEQ ID NO: 5701 - protein, 4 aa, Artificial Sequence
  Description of Artificial Sequence: Synthetic peptide
VFGG

SEQ ID NO: 5702 - protein, 4 aa, Artificial Sequence
  Description of Artificial Sequence: Synthetic peptide
RFGE

SEQ ID NO: 5703 - protein, 4 aa, Artificial Sequence
  Description of Artificial Sequence: Synthetic peptide
MFGV

SEQ ID NO: 5704 - protein, 4 aa, Artificial Sequence
  Description of Artificial Sequence: Synthetic peptide
VFGA

SEQ ID NO: 5705 - protein, 4 aa, Artificial Sequence
  Description of Artificial Sequence: Synthetic peptide
VFGE

SEQ ID NO: 5706 - protein, 4 aa, Artificial Sequence
  Description of Artificial Sequence: Synthetic peptide
VFGV

SEQ ID NO: 5707 - protein, 4 aa, Artificial Sequence
  Description of Artificial Sequence: Synthetic peptide
MFGG

SEQ ID NO: 5708 - protein, 4 aa, Artificial Sequence
  Description of Artificial Sequence: Synthetic peptide
LFGV

SEQ ID NO: 5709 - protein, 4 aa, Artificial Sequence
  Description of Artificial Sequence: Synthetic peptide
SFGE

SEQ ID NO: 5710 - protein, 4 aa, Artificial Sequence
  Description of Artificial Sequence: Synthetic peptide
SFGA

SEQ ID NO: 5711 - protein, 4 aa, Artificial Sequence
  Description of Artificial Sequence: Synthetic peptide
RFGG

SEQ ID NO: 5712 - protein, 4 aa, Artificial Sequence
  Description of Artificial Sequence: Synthetic peptide
SFGV

SEQ ID NO: 5713 - protein, 4 aa, Artificial Sequence
  Description of Artificial Sequence: Synthetic peptide
LFGA

SEQ ID NO: 5714 - protein, 4 aa, Artificial Sequence
  Description of Artificial Sequence: Synthetic peptide
SFGG

SEQ ID NO: 5715 - protein, 4 aa, Artificial Sequence
  Description of Artificial Sequence: Synthetic peptide
LFGG

SEQ ID NO: 5716 - protein, 4 aa, Artificial Sequence
  Description of Artificial Sequence: Synthetic peptide
LFGE

SEQ ID NO: 5717 - protein, 4 aa, Artificial Sequence
  Description of Artificial Sequence: Synthetic peptide
WFGG

SEQ ID NO: 5718 - protein, 4 aa, Artificial Sequence
  Description of Artificial Sequence: Synthetic peptide
WFGV

SEQ ID NO: 5719 - protein, 4 aa, Artificial Sequence
  Description of Artificial Sequence: Synthetic peptide
WFGA

SEQ ID NO: 5720 - protein, 4 aa, Artificial Sequence
  Description of Artificial Sequence: Synthetic peptide
TFGE

SEQ ID NO: 5721 - protein, 4 aa, Artificial Sequence
  Description of Artificial Sequence: Synthetic peptide
AFGV

SEQ ID NO: 5722 - protein, 4 aa, Artificial Sequence
  Description of Artificial Sequence: Synthetic peptide
AFGA

SEQ ID NO: 5723 - protein, 4 aa, Artificial Sequence
  Description of Artificial Sequence: Synthetic peptide
GFGV

SEQ ID NO: 5724 - protein, 4 aa, Artificial Sequence
  Description of Artificial Sequence: Synthetic peptide
GFGA

SEQ ID NO: 5725 - protein, 4 aa, Artificial Sequence
  Description of Artificial Sequence: Synthetic peptide
GFGG

SEQ ID NO: 5726 - protein, 4 aa, Artificial Sequence
  Description of Artificial Sequence: Synthetic peptide
TFGV

SEQ ID NO: 5727 - protein, 4 aa, Artificial Sequence
  Description of Artificial Sequence: Synthetic peptide
AFGE

SEQ ID NO: 5728 - protein, 4 aa, Artificial Sequence
  Description of Artificial Sequence: Synthetic peptide
TFGA

SEQ ID NO: 5729 - protein, 4 aa, Artificial Sequence
  Description of Artificial Sequence: Synthetic peptide
RFGV

SEQ ID NO: 5730 - protein, 4 aa, Artificial Sequence
  Description of Artificial Sequence: Synthetic peptide
AFGG

SEQ ID NO: 5731 - protein, 4 aa, Artificial Sequence
  Description of Artificial Sequence: Synthetic peptide
GFGE

SEQ ID NO: 5732 - protein, 4 aa, Artificial Sequence
  Description of Artificial Sequence: Synthetic peptide
AGDY

SEQ ID NO: 5733 - protein, 4 aa, Artificial Sequence
  Description of Artificial Sequence: Synthetic peptide
PGYY

SEQ ID NO: 5734 - protein, 4 aa, Artificial Sequence
  Description of Artificial Sequence: Synthetic peptide
VGAY

SEQ ID NO: 5735 - protein, 4 aa, Artificial Sequence
  Description of Artificial Sequence: Synthetic peptide
HGSY

SEQ ID NO: 5736 - protein, 4 aa, Artificial Sequence
  Description of Artificial Sequence: Synthetic peptide
PGDY

SEQ ID NO: 5737 - protein, 4 aa, Artificial Sequence
  Description of Artificial Sequence: Synthetic peptide
LGDY

SEQ ID NO: 5738 - protein, 4 aa, Artificial Sequence
  Description of Artificial Sequence: Synthetic peptide
DGAY

SEQ ID NO: 5739 - protein, 4 aa, Artificial Sequence
  Description of Artificial Sequence: Synthetic peptide
FGDY

SEQ ID NO: 5740 - protein, 4 aa, Artificial Sequence
  Description of Artificial Sequence: Synthetic peptide
LGAY

SEQ ID NO: 5741 - protein, 4 aa, Artificial Sequence
  Description of Artificial Sequence: Synthetic peptide
DGYY

SEQ ID NO: 5742 - protein, 4 aa, Artificial Sequence
  Description of Artificial Sequence: Synthetic peptide
VGSY

SEQ ID NO: 5743 - protein, 4 aa, Artificial Sequence
  Description of Artificial Sequence: Synthetic peptide
YGAY

SEQ ID NO: 5744 - protein, 4 aa, Artificial Sequence
  Description of Artificial Sequence: Synthetic peptide
FGYY

SEQ ID NO: 5745 - protein, 4 aa, Artificial Sequence
  Description of Artificial Sequence: Synthetic peptide
DGDY

SEQ ID NO: 5746 - protein, 4 aa, Artificial Sequence
  Description of Artificial Sequence: Synthetic peptide
AGYY

SEQ ID NO: 5747 - protein, 4 aa, Artificial Sequence
  Description of Artificial Sequence: Synthetic peptide
YGSY

SEQ ID NO: 5748 - protein, 4 aa, Artificial Sequence
  Description of Artificial Sequence: Synthetic peptide
VGYY

SEQ ID NO: 5749 - protein, 4 aa, Artificial Sequence
  Description of Artificial Sequence: Synthetic peptide
AGAY

SEQ ID NO: 5750 - protein, 4 aa, Artificial Sequence
  Description of Artificial Sequence: Synthetic peptide
DGSY

SEQ ID NO: 5751 - protein, 4 aa, Artificial Sequence
  Description of Artificial Sequence: Synthetic peptide
HGDY

SEQ ID NO: 5752 - protein, 4 aa, Artificial Sequence
  Description of Artificial Sequence: Synthetic peptide
FGAY

SEQ ID NO: 5753 - protein, 4 aa, Artificial Sequence
  Description of Artificial Sequence: Synthetic peptide
HGYY

SEQ ID NO: 5754 - protein, 4 aa, Artificial Sequence
  Description of Artificial Sequence: Synthetic peptide
YGYY

SEQ ID NO: 5755 - protein, 4 aa, Artificial Sequence
  Description of Artificial Sequence: Synthetic peptide
SGAY

SEQ ID NO: 5756 - protein, 4 aa, Artificial Sequence
  Description of Artificial Sequence: Synthetic peptide
AGSY

SEQ ID NO: 5757 - protein, 4 aa, Artificial Sequence
  Description of Artificial Sequence: Synthetic peptide
HGAY

SEQ ID NO: 5758 - protein, 4 aa, Artificial Sequence
  Description of Artificial Sequence: Synthetic peptide
PGAY

SEQ ID NO: 5759 - protein, 4 aa, Artificial Sequence
  Description of Artificial Sequence: Synthetic peptide
PGSY

SEQ ID NO: 5760 - protein, 4 aa, Artificial Sequence
  Description of Artificial Sequence: Synthetic peptide
LGSY

SEQ ID NO: 5761 - protein, 4 aa, Artificial Sequence
  Description of Artificial Sequence: Synthetic peptide
VGDY

SEQ ID NO: 5762 - protein, 4 aa, Artificial Sequence
  Description of Artificial Sequence: Synthetic peptide
SGDY

SEQ ID NO: 5763 - protein, 4 aa, Artificial Sequence
  Description of Artificial Sequence: Synthetic peptide
LGYY

SEQ ID NO: 5764 - protein, 4 aa, Artificial Sequence
  Description of Artificial Sequence: Synthetic peptide
FGSY

SEQ ID NO: 5765 - protein, 4 aa, Artificial Sequence
  Description of Artificial Sequence: Synthetic peptide
YSSV

SEQ ID NO: 5766 - protein, 4 aa, Artificial Sequence
  Description of Artificial Sequence: Synthetic peptide
YSSI

SEQ ID NO: 5767 - protein, 4 aa, Artificial Sequence
  Description of Artificial Sequence: Synthetic peptide
YSSR

SEQ ID NO: 5768 - protein, 4 aa, Artificial Sequence
  Description of Artificial Sequence: Synthetic peptide
YSSP

SEQ ID NO: 5769 - protein, 4 aa, Artificial Sequence
  Description of Artificial Sequence: Synthetic peptide
YSSA

SEQ ID NO: 5770 - protein, 4 aa, Artificial Sequence
  Description of Artificial Sequence: Synthetic peptide
YSSL

SEQ ID NO: 5771 - protein, 4 aa, Artificial Sequence
  Description of Artificial Sequence: Synthetic peptide
YSST

SEQ ID NO: 5772 - protein, 4 aa, Artificial Sequence
  Description of Artificial Sequence: Synthetic peptide
EVRG

SEQ ID NO: 5773 - protein, 4 aa, Artificial Sequence
  Description of Artificial Sequence: Synthetic peptide
PVRG

SEQ ID NO: 5774 - protein, 4 aa, Artificial Sequence
  Description of Artificial Sequence: Synthetic peptide
PVTG

SEQ ID NO: 5775 - protein, 4 aa, Artificial Sequence
  Description of Artificial Sequence: Synthetic peptide
EVAG

SEQ ID NO: 5776 - protein, 4 aa, Artificial Sequence
  Description of Artificial Sequence: Synthetic peptide
MVTG

SEQ ID NO: 5777 - protein, 4 aa, Artificial Sequence
  Description of Artificial Sequence: Synthetic peptide
MVGG

SEQ ID NO: 5778 - protein, 4 aa, Artificial Sequence
  Description of Artificial Sequence: Synthetic peptide
QVRG

SEQ ID NO: 5779 - protein, 4 aa, Artificial Sequence
  Description of Artificial Sequence: Synthetic peptide
QVGG

SEQ ID NO: 5780 - protein, 4 aa, Artificial Sequence
  Description of Artificial Sequence: Synthetic peptide
VVAG

SEQ ID NO: 5781 - protein, 4 aa, Artificial Sequence
  Description of Artificial Sequence: Synthetic peptide
EVTG

SEQ ID NO: 5782 - protein, 4 aa, Artificial Sequence
  Description of Artificial Sequence: Synthetic peptide
VVRG

SEQ ID NO: 5783 - protein, 4 aa, Artificial Sequence
  Description of Artificial Sequence: Synthetic peptide
PVAG

SEQ ID NO: 5784 - protein, 4 aa, Artificial Sequence
  Description of Artificial Sequence: Synthetic peptide
LVAG

SEQ ID NO: 5785 - protein, 4 aa, Artificial Sequence
  Description of Artificial Sequence: Synthetic peptide
LVRG

SEQ ID NO: 5786 - protein, 4 aa, Artificial Sequence
  Description of Artificial Sequence: Synthetic peptide
QVTG

SEQ ID NO: 5787 - protein, 4 aa, Artificial Sequence
  Description of Artificial Sequence: Synthetic peptide
PVGG

SEQ ID NO: 5788 - protein, 4 aa, Artificial Sequence
  Description of Artificial Sequence: Synthetic peptide
AVGG

SEQ ID NO: 5789 - protein, 4 aa, Artificial Sequence
  Description of Artificial Sequence: Synthetic peptide
TVGG

SEQ ID NO: 5790 - protein, 4 aa, Artificial Sequence
  Description of Artificial Sequence: Synthetic peptide
KVGG

SEQ ID NO: 5791 - protein, 4 aa, Artificial Sequence
  Description of Artificial Sequence: Synthetic peptide
TVAG

SEQ ID NO: 5792 - protein, 4 aa, Artificial Sequence
  Description of Artificial Sequence: Synthetic peptide
AVTG

SEQ ID NO: 5793 - protein, 4 aa, Artificial Sequence
  Description of Artificial Sequence: Synthetic peptide
KVRG

SEQ ID NO: 5794 - protein, 4 aa, Artificial Sequence
  Description of Artificial Sequence: Synthetic peptide
LVTG

SEQ ID NO: 5795 - protein, 4 aa, Artificial Sequence
  Description of Artificial Sequence: Synthetic peptide
AVRG

SEQ ID NO: 5796 - protein, 4 aa, Artificial Sequence
  Description of Artificial Sequence: Synthetic peptide
LVGG

SEQ ID NO: 5797 - protein, 4 aa, Artificial Sequence
  Description of Artificial Sequence: Synthetic peptide
QVAG

SEQ ID NO: 5798 - protein, 4 aa, Artificial Sequence
  Description of Artificial Sequence: Synthetic peptide
KVTG

SEQ ID NO: 5799 - protein, 4 aa, Artificial Sequence
  Description of Artificial Sequence: Synthetic peptide
TVTG

SEQ ID NO: 5800 - protein, 4 aa, Artificial Sequence
  Description of Artificial Sequence: Synthetic peptide
VVGG

SEQ ID NO: 5801 - protein, 4 aa, Artificial Sequence
  Description of Artificial Sequence: Synthetic peptide
KVAG

SEQ ID NO: 5802 - protein, 4 aa, Artificial Sequence
  Description of Artificial Sequence: Synthetic peptide
MVAG

SEQ ID NO: 5803 - protein, 4 aa, Artificial Sequence
  Description of Artificial Sequence: Synthetic peptide
VVTG

SEQ ID NO: 5804 - protein, 4 aa, Artificial Sequence
  Description of Artificial Sequence: Synthetic peptide
TVRG

SEQ ID NO: 5805 - protein, 4 aa, Artificial Sequence
  Description of Artificial Sequence: Synthetic peptide
SDGY

SEQ ID NO: 5806 - protein, 4 aa, Artificial Sequence
  Description of Artificial Sequence: Synthetic peptide
IDGF

SEQ ID NO: 5807 - protein, 4 aa, Artificial Sequence
  Description of Artificial Sequence: Synthetic peptide
ADGY

SEQ ID NO: 5808 - protein, 4 aa, Artificial Sequence
  Description of Artificial Sequence: Synthetic peptide
ADGS

SEQ ID NO: 5809 - protein, 4 aa, Artificial Sequence
  Description of Artificial Sequence: Synthetic peptide
RDGF

SEQ ID NO: 5810 - protein, 4 aa, Artificial Sequence
  Description of Artificial Sequence: Synthetic peptide
IDGS

SEQ ID NO: 5811 - protein, 4 aa, Artificial Sequence
  Description of Artificial Sequence: Synthetic peptide
GDGS

SEQ ID NO: 5812 - protein, 4 aa, Artificial Sequence
  Description of Artificial Sequence: Synthetic peptide
LDGY

SEQ ID NO: 5813 - protein, 4 aa, Artificial Sequence
  Description of Artificial Sequence: Synthetic peptide
GDGY

SEQ ID NO: 5814 - protein, 4 aa, Artificial Sequence
  Description of Artificial Sequence: Synthetic peptide
IDGY

SEQ ID NO: 5815 - protein, 4 aa, Artificial Sequence
  Description of Artificial Sequence: Synthetic peptide
SDGS

SEQ ID NO: 5816 - protein, 4 aa, Artificial Sequence
  Description of Artificial Sequence: Synthetic peptide
SDGF

SEQ ID NO: 5817 - protein, 4 aa, Artificial Sequence
  Description of Artificial Sequence: Synthetic peptide
VDGF

SEQ ID NO: 5818 - protein, 4 aa, Artificial Sequence
  Description of Artificial Sequence: Synthetic peptide
GDGF

SEQ ID NO: 5819 - protein, 4 aa, Artificial Sequence
  Description of Artificial Sequence: Synthetic peptide
TDGY

SEQ ID NO: 5820 - protein, 4 aa, Artificial Sequence
  Description of Artificial Sequence: Synthetic peptide
VDGY

SEQ ID NO: 5821 - protein, 4 aa, Artificial Sequence
  Description of Artificial Sequence: Synthetic peptide
TDGS

SEQ ID NO: 5822 - protein, 4 aa, Artificial Sequence
  Description of Artificial Sequence: Synthetic peptide
RDGS

SEQ ID NO: 5823 - protein, 4 aa, Artificial Sequence
  Description of Artificial Sequence: Synthetic peptide
LDGF

SEQ ID NO: 5824 - protein, 4 aa, Artificial Sequence
  Description of Artificial Sequence: Synthetic peptide
VDGS

SEQ ID NO: 5825 - protein, 4 aa, Artificial Sequence
  Description of Artificial Sequence: Synthetic peptide
ADGF

SEQ ID NO: 5826 - protein, 4 aa, Artificial Sequence
  Description of Artificial Sequence: Synthetic peptide
LDGS

SEQ ID NO: 5827 - protein, 4 aa, Artificial Sequence
  Description of Artificial Sequence: Synthetic peptide
PDGS

SEQ ID NO: 5828 - protein, 4 aa, Artificial Sequence
  Description of Artificial Sequence: Synthetic peptide
PDGF

SEQ ID NO: 5829 - protein, 4 aa, Artificial Sequence
  Description of Artificial Sequence: Synthetic peptide
PDGY

SEQ ID NO: 5830 - protein, 4 aa, Artificial Sequence
  Description of Artificial Sequence: Synthetic peptide
TDGF

SEQ ID NO: 5831 - protein, 4 aa, Artificial Sequence
  Description of Artificial Sequence: Synthetic peptide
NYGG

SEQ ID NO: 5832 - protein, 4 aa, Artificial Sequence
  Description of Artificial Sequence: Synthetic peptide
TYGD

SEQ ID NO: 5833 - protein, 4 aa, Artificial Sequence
  Description of Artificial Sequence: Synthetic peptide
LYGD

SEQ ID NO: 5834 - protein, 4 aa, Artificial Sequence
  Description of Artificial Sequence: Synthetic peptide
FYGG

SEQ ID NO: 5835 - protein, 4 aa, Artificial Sequence
  Description of Artificial Sequence: Synthetic peptide
SYGG

SEQ ID NO: 5836 - protein, 4 aa, Artificial Sequence
  Description of Artificial Sequence: Synthetic peptide
TYGG

SEQ ID NO: 5837 - protein, 4 aa, Artificial Sequence
  Description of Artificial Sequence: Synthetic peptide
LYGA

SEQ ID NO: 5838 - protein, 4 aa, Artificial Sequence
  Description of Artificial Sequence: Synthetic peptide
SYGA

SEQ ID NO: 5839 - protein, 4 aa, Artificial Sequence
  Description of Artificial Sequence: Synthetic peptide
LYGG

SEQ ID NO: 5840 - protein, 4 aa, Artificial Sequence
  Description of Artificial Sequence: Synthetic peptide
VYGD

SEQ ID NO: 5841 - protein, 4 aa, Artificial Sequence
  Description of Artificial Sequence: Synthetic peptide
SYGD

SEQ ID NO: 5842 - protein, 4 aa, Artificial Sequence
  Description of Artificial Sequence: Synthetic peptide
AYGG

SEQ ID NO: 5843 - protein, 4 aa, Artificial Sequence
  Description of Artificial Sequence: Synthetic peptide
VYGG

SEQ ID NO: 5844 - protein, 4 aa, Artificial Sequence
  Description of Artificial Sequence: Synthetic peptide
HYGG

SEQ ID NO: 5845 - protein, 4 aa, Artificial Sequence
  Description of Artificial Sequence: Synthetic peptide
FYGA

SEQ ID NO: 5846 - protein, 4 aa, Artificial Sequence
  Description of Artificial Sequence: Synthetic peptide
NYGD

SEQ ID NO: 5847 - protein, 4 aa, Artificial Sequence
  Description of Artificial Sequence: Synthetic peptide
TYGA

SEQ ID NO: 5848 - protein, 4 aa, Artificial Sequence
  Description of Artificial Sequence: Synthetic peptide
FYGD

SEQ ID NO: 5849 - protein, 4 aa, Artificial Sequence
  Description of Artificial Sequence: Synthetic peptide
IYGD

SEQ ID NO: 5850 - protein, 4 aa, Artificial Sequence
  Description of Artificial Sequence: Synthetic peptide
PYGD

SEQ ID NO: 5851 - protein, 4 aa, Artificial Sequence
  Description of Artificial Sequence: Synthetic peptide
DYGA

SEQ ID NO: 5852 - protein, 4 aa, Artificial Sequence
  Description of Artificial Sequence: Synthetic peptide
HYGA

SEQ ID NO: 5853 - protein, 4 aa, Artificial Sequence
  Description of Artificial Sequence: Synthetic peptide
PYGA

SEQ ID NO: 5854 - protein, 4 aa, Artificial Sequence
  Description of Artificial Sequence: Synthetic peptide
PYGG

SEQ ID NO: 5855 - protein, 4 aa, Artificial Sequence
  Description of Artificial Sequence: Synthetic peptide
HYGD

SEQ ID NO: 5856 - protein, 4 aa, Artificial Sequence
  Description of Artificial Sequence: Synthetic peptide
AYGA

SEQ ID NO: 5857 - protein, 4 aa, Artificial Sequence
  Description of Artificial Sequence: Synthetic peptide
VYGA

SEQ ID NO: 5858 - protein, 4 aa, Artificial Sequence
  Description of Artificial Sequence: Synthetic peptide
YYGD

SEQ ID NO: 5859 - protein, 4 aa, Artificial Sequence
  Description of Artificial Sequence: Synthetic peptide
AYGD

SEQ ID NO: 5860 - protein, 4 aa, Artificial Sequence
  Description of Artificial Sequence: Synthetic peptide
NYGA

SEQ ID NO: 5861 - protein, 4 aa, Artificial Sequence
  Description of Artificial Sequence: Synthetic peptide
YYGA

SEQ ID NO: 5862 - protein, 4 aa, Artificial Sequence
  Description of Artificial Sequence: Synthetic peptide
YYGG

SEQ ID NO: 5863 - protein, 4 aa, Artificial Sequence
  Description of Artificial Sequence: Synthetic peptide
IYGG

SEQ ID NO: 5864 - protein, 4 aa, Artificial Sequence
  Description of Artificial Sequence: Synthetic peptide
IYGA

SEQ ID NO: 5865 - protein, 4 aa, Artificial Sequence
  Description of Artificial Sequence: Synthetic peptide
LMAT

SEQ ID NO: 5866 - protein, 4 aa, Artificial Sequence
  Description of Artificial Sequence: Synthetic peptide
VTAT

SEQ ID NO: 5867 - protein, 4 aa, Artificial Sequence
  Description of Artificial Sequence: Synthetic peptide
KMAT

SEQ ID NO: 5868 - protein, 4 aa, Artificial Sequence
  Description of Artificial Sequence: Synthetic peptide
QMAT

SEQ ID NO: 5869 - protein, 4 aa, Artificial Sequence
  Description of Artificial Sequence: Synthetic peptide
ETAT

SEQ ID NO: 5870 - protein, 4 aa, Artificial Sequence
  Description of Artificial Sequence: Synthetic peptide
TTAT

SEQ ID NO: 5871 - protein, 4 aa, Artificial Sequence
  Description of Artificial Sequence: Synthetic peptide
TMAT

SEQ ID NO: 5872 - protein, 4 aa, Artificial Sequence
  Description of Artificial Sequence: Synthetic peptide
PTAT

SEQ ID NO: 5873 - protein, 4 aa, Artificial Sequence
  Description of Artificial Sequence: Synthetic peptide
VMAT

SEQ ID NO: 5874 - protein, 4 aa, Artificial Sequence
  Description of Artificial Sequence: Synthetic peptide
LTAT

SEQ ID NO: 5875 - protein, 4 aa, Artificial Sequence
  Description of Artificial Sequence: Synthetic peptide
KTAT

SEQ ID NO: 5876 - protein, 4 aa, Artificial Sequence
  Description of Artificial Sequence: Synthetic peptide
MMAT

SEQ ID NO: 5877 - protein, 4 aa, Artificial Sequence
  Description of Artificial Sequence: Synthetic peptide
ATAT

SEQ ID NO: 5878 - protein, 4 aa, Artificial Sequence
  Description of Artificial Sequence: Synthetic peptide
QTAT

SEQ ID NO: 5879 - protein, 4 aa, Artificial Sequence
  Description of Artificial Sequence: Synthetic peptide
PMAT

SEQ ID NO: 5880 - protein, 4 aa, Artificial Sequence
  Description of Artificial Sequence: Synthetic peptide
MTAT

SEQ ID NO: 5881 - protein, 4 aa, Artificial Sequence
  Description of Artificial Sequence: Synthetic peptide
AMAT

SEQ ID NO: 5882 - protein, 4 aa, Artificial Sequence
  Description of Artificial Sequence: Synthetic peptide
TYSA

SEQ ID NO: 5883 - protein, 4 aa, Artificial Sequence
  Description of Artificial Sequence: Synthetic peptide
LYSS

SEQ ID NO: 5884 - protein, 4 aa, Artificial Sequence
  Description of Artificial Sequence: Synthetic peptide
LYST

SEQ ID NO: 5885 - protein, 4 aa, Artificial Sequence
  Description of Artificial Sequence: Synthetic peptide
QYSS

SEQ ID NO: 5886 - protein, 4 aa, Artificial Sequence
  Description of Artificial Sequence: Synthetic peptide
VYST

SEQ ID NO: 5887 - protein, 4 aa, Artificial Sequence
  Description of Artificial Sequence: Synthetic peptide
VYSS

SEQ ID NO: 5888 - protein, 4 aa, Artificial Sequence
  Description of Artificial Sequence: Synthetic peptide
AYSA

SEQ ID NO: 5889 - protein, 4 aa, Artificial Sequence
  Description of Artificial Sequence: Synthetic peptide
PYSG

SEQ ID NO: 5890 - protein, 4 aa, Artificial Sequence
  Description of Artificial Sequence: Synthetic peptide
PYST

SEQ ID NO: 5891 - protein, 4 aa, Artificial Sequence
  Description of Artificial Sequence: Synthetic peptide
VYSA

SEQ ID NO: 5892 - protein, 4 aa, Artificial Sequence
  Description of Artificial Sequence: Synthetic peptide
PYSS

SEQ ID NO: 5893 - protein, 4 aa, Artificial Sequence
  Description of Artificial Sequence: Synthetic peptide
VYSG

SEQ ID NO: 5894 - protein, 4 aa, Artificial Sequence
  Description of Artificial Sequence: Synthetic peptide
PYSA

SEQ ID NO: 5895 - protein, 4 aa, Artificial Sequence
  Description of Artificial Sequence: Synthetic peptide
KYST

SEQ ID NO: 5896 - protein, 4 aa, Artificial Sequence
  Description of Artificial Sequence: Synthetic peptide
QYST

SEQ ID NO: 5897 - protein, 4 aa, Artificial Sequence
  Description of Artificial Sequence: Synthetic peptide
TYSG

SEQ ID NO: 5898 - protein, 4 aa, Artificial Sequence
  Description of Artificial Sequence: Synthetic peptide
TYST

SEQ ID NO: 5899 - protein, 4 aa, Artificial Sequence
  Description of Artificial Sequence: Synthetic peptide
QYSA

SEQ ID NO: 5900 - protein, 4 aa, Artificial Sequence
  Description of Artificial Sequence: Synthetic peptide
AYSS

SEQ ID NO: 5901 - protein, 4 aa, Artificial Sequence
  Description of Artificial Sequence: Synthetic peptide
TYSS

SEQ ID NO: 5902 - protein, 4 aa, Artificial Sequence
  Description of Artificial Sequence: Synthetic peptide
IYSA

SEQ ID NO: 5903 - protein, 4 aa, Artificial Sequence
  Description of Artificial Sequence: Synthetic peptide
AYST

SEQ ID NO: 5904 - protein, 4 aa, Artificial Sequence
  Description of Artificial Sequence: Synthetic peptide
IYSG

SEQ ID NO: 5905 - protein, 4 aa, Artificial Sequence
  Description of Artificial Sequence: Synthetic peptide
KYSG

SEQ ID NO: 5906 - protein, 4 aa, Artificial Sequence
  Description of Artificial Sequence: Synthetic peptide
EYSA

SEQ ID NO: 5907 - protein, 4 aa, Artificial Sequence
  Description of Artificial Sequence: Synthetic peptide
LYSG

SEQ ID NO: 5908 - protein, 4 aa, Artificial Sequence
  Description of Artificial Sequence: Synthetic peptide
AYSG

SEQ ID NO: 5909 - protein, 4 aa, Artificial Sequence
  Description of Artificial Sequence: Synthetic peptide
EYSG

SEQ ID NO: 5910 - protein, 4 aa, Artificial Sequence
  Description of Artificial Sequence: Synthetic peptide
LYSA

SEQ ID NO: 5911 - protein, 4 aa, Artificial Sequence
  Description of Artificial Sequence: Synthetic peptide
QYSG

SEQ ID NO: 5912 - protein, 4 aa, Artificial Sequence
  Description of Artificial Sequence: Synthetic peptide
IYST

SEQ ID NO: 5913 - protein, 4 aa, Artificial Sequence
  Description of Artificial Sequence: Synthetic peptide
EYST

SEQ ID NO: 5914 - protein, 4 aa, Artificial Sequence
  Description of Artificial Sequence: Synthetic peptide
KYSS

SEQ ID NO: 5915 - protein, 4 aa, Artificial Sequence
  Description of Artificial Sequence: Synthetic peptide
IYSS

SEQ ID NO: 5916 - protein, 4 aa, Artificial Sequence
  Description of Artificial Sequence: Synthetic peptide
KYSA

SEQ ID NO: 5917 - protein, 4 aa, Artificial Sequence
  Description of Artificial Sequence: Synthetic peptide
QWLS

SEQ ID NO: 5918 - protein, 4 aa, Artificial Sequence
  Description of Artificial Sequence: Synthetic peptide
QWLL

SEQ ID NO: 5919 - protein, 4 aa, Artificial Sequence
  Description of Artificial Sequence: Synthetic peptide
QWLP

SEQ ID NO: 5920 - protein, 4 aa, Artificial Sequence
  Description of Artificial Sequence: Synthetic peptide
QWLD

SEQ ID NO: 5921 - protein, 4 aa, Artificial Sequence
  Description of Artificial Sequence: Synthetic peptide
QWLY

SEQ ID NO: 5922 - protein, 4 aa, Artificial Sequence
  Description of Artificial Sequence: Synthetic peptide
QWLA

SEQ ID NO: 5923 - protein, 4 aa, Artificial Sequence
  Description of Artificial Sequence: Synthetic peptide
QWLH

SEQ ID NO: 5924 - protein, 4 aa, Artificial Sequence
  Description of Artificial Sequence: Synthetic peptide
QWLF

SEQ ID NO: 5925 - protein, 4 aa, Artificial Sequence
  Description of Artificial Sequence: Synthetic peptide
PVAD

SEQ ID NO: 5926 - protein, 4 aa, Artificial Sequence
  Description of Artificial Sequence: Synthetic peptide
PVAA

SEQ ID NO: 5927 - protein, 4 aa, Artificial Sequence
  Description of Artificial Sequence: Synthetic peptide
IVAA

SEQ ID NO: 5928 - protein, 4 aa, Artificial Sequence
  Description of Artificial Sequence: Synthetic peptide
EVAA

SEQ ID NO: 5929 - protein, 4 aa, Artificial Sequence
  Description of Artificial Sequence: Synthetic peptide
EVAV

SEQ ID NO: 5930 - protein, 4 aa, Artificial Sequence
  Description of Artificial Sequence: Synthetic peptide
IVAD

SEQ ID NO: 5931 - protein, 4 aa, Artificial Sequence
  Description of Artificial Sequence: Synthetic peptide
EVAD

SEQ ID NO: 5932 - protein, 4 aa, Artificial Sequence
  Description of Artificial Sequence: Synthetic peptide
IVAG

SEQ ID NO: 5933 - protein, 4 aa, Artificial Sequence
  Description of Artificial Sequence: Synthetic peptide
QVAD

SEQ ID NO: 5934 - protein, 4 aa, Artificial Sequence
  Description of Artificial Sequence: Synthetic peptide
AVAA

SEQ ID NO: 5935 - protein, 4 aa, Artificial Sequence
  Description of Artificial Sequence: Synthetic peptide
AVAV

SEQ ID NO: 5936 - protein, 4 aa, Artificial Sequence
  Description of Artificial Sequence: Synthetic peptide
AVAD

SEQ ID NO: 5937 - protein, 4 aa, Artificial Sequence
  Description of Artificial Sequence: Synthetic peptide
KVAA

SEQ ID NO: 5938 - protein, 4 aa, Artificial Sequence
  Description of Artificial Sequence: Synthetic peptide
QVAA

SEQ ID NO: 5939 - protein, 4 aa, Artificial Sequence
  Description of Artificial Sequence: Synthetic peptide
TVAV

SEQ ID NO: 5940 - protein, 4 aa, Artificial Sequence
  Description of Artificial Sequence: Synthetic peptide
LVAD

SEQ ID NO: 5941 - protein, 4 aa, Artificial Sequence
  Description of Artificial Sequence: Synthetic peptide
LVAA

SEQ ID NO: 5942 - protein, 4 aa, Artificial Sequence
  Description of Artificial Sequence: Synthetic peptide
IVAV

SEQ ID NO: 5943 - protein, 4 aa, Artificial Sequence
  Description of Artificial Sequence: Synthetic peptide
VVAD

SEQ ID NO: 5944 - protein, 4 aa, Artificial Sequence
  Description of Artificial Sequence: Synthetic peptide
VVAV

SEQ ID NO: 5945 - protein, 4 aa, Artificial Sequence
  Description of Artificial Sequence: Synthetic peptide
QVAV

SEQ ID NO: 5946 - protein, 4 aa, Artificial Sequence
  Description of Artificial Sequence: Synthetic peptide
PVAV

SEQ ID NO: 5947 - protein, 4 aa, Artificial Sequence
  Description of Artificial Sequence: Synthetic peptide
KVAV

SEQ ID NO: 5948 - protein, 4 aa, Artificial Sequence
  Description of Artificial Sequence: Synthetic peptide
LVAV

SEQ ID NO: 5949 - protein, 4 aa, Artificial Sequence
  Description of Artificial Sequence: Synthetic peptide
TVAD

SEQ ID NO: 5950 - protein, 4 aa, Artificial Sequence
  Description of Artificial Sequence: Synthetic peptide
KVAD

SEQ ID NO: 5951 - protein, 4 aa, Artificial Sequence
  Description of Artificial Sequence: Synthetic peptide
TVAA

SEQ ID NO: 5952 - protein, 4 aa, Artificial Sequence
  Description of Artificial Sequence: Synthetic peptide
STVA

SEQ ID NO: 5953 - protein, 4 aa, Artificial Sequence
  Description of Artificial Sequence: Synthetic peptide
STVK

SEQ ID NO: 5954 - protein, 4 aa, Artificial Sequence
  Description of Artificial Sequence: Synthetic peptide
RTVA

SEQ ID NO: 5955 - protein, 4 aa, Artificial Sequence
  Description of Artificial Sequence: Synthetic peptide
ITVT

SEQ ID NO: 5956 - protein, 4 aa, Artificial Sequence
  Description of Artificial Sequence: Synthetic peptide
PTVA

SEQ ID NO: 5957 - protein, 4 aa, Artificial Sequence
  Description of Artificial Sequence: Synthetic peptide
ATVT

SEQ ID NO: 5958 - protein, 4 aa, Artificial Sequence
  Description of Artificial Sequence: Synthetic peptide
ATVK

SEQ ID NO: 5959 - protein, 4 aa, Artificial Sequence
  Description of Artificial Sequence: Synthetic peptide
VTVK

SEQ ID NO: 5960 - protein, 4 aa, Artificial Sequence
  Description of Artificial Sequence: Synthetic peptide
TTVK

SEQ ID NO: 5961 - protein, 4 aa, Artificial Sequence
  Description of Artificial Sequence: Synthetic peptide
PTVE

SEQ ID NO: 5962 - protein, 4 aa, Artificial Sequence
  Description of Artificial Sequence: Synthetic peptide
VTVT

SEQ ID NO: 5963 - protein, 4 aa, Artificial Sequence
  Description of Artificial Sequence: Synthetic peptide
STVT

SEQ ID NO: 5964 - protein, 4 aa, Artificial Sequence
  Description of Artificial Sequence: Synthetic peptide
VTVE

SEQ ID NO: 5965 - protein, 4 aa, Artificial Sequence
  Description of Artificial Sequence: Synthetic peptide
LTVA

SEQ ID NO: 5966 - protein, 4 aa, Artificial Sequence
  Description of Artificial Sequence: Synthetic peptide
RTVT

SEQ ID NO: 5967 - protein, 4 aa, Artificial Sequence
  Description of Artificial Sequence: Synthetic peptide
LTVE

SEQ ID NO: 5968 - protein, 4 aa, Artificial Sequence
  Description of Artificial Sequence: Synthetic peptide
TTVE

SEQ ID NO: 5969 - protein, 4 aa, Artificial Sequence
  Description of Artificial Sequence: Synthetic peptide
RTVK

SEQ ID NO: 5970 - protein, 4 aa, Artificial Sequence
  Description of Artificial Sequence: Synthetic peptide
VTVA

SEQ ID NO: 5971 - protein, 4 aa, Artificial Sequence
  Description of Artificial Sequence: Synthetic peptide
STVE

SEQ ID NO: 5972 - protein, 4 aa, Artificial Sequence
  Description of Artificial Sequence: Synthetic peptide
ATVA

SEQ ID NO: 5973 - protein, 4 aa, Artificial Sequence
  Description of Artificial Sequence: Synthetic peptide
GTVE

SEQ ID NO: 5974 - protein, 4 aa, Artificial Sequence
  Description of Artificial Sequence: Synthetic peptide
GTVA

SEQ ID NO: 5975 - protein, 4 aa, Artificial Sequence
  Description of Artificial Sequence: Synthetic peptide
ITVE

SEQ ID NO: 5976 - protein, 4 aa, Artificial Sequence
  Description of Artificial Sequence: Synthetic peptide
PTVT

SEQ ID NO: 5977 - protein, 4 aa, Artificial Sequence
  Description of Artificial Sequence: Synthetic peptide
ITVA

SEQ ID NO: 5978 - protein, 4 aa, Artificial Sequence
  Description of Artificial Sequence: Synthetic peptide
ATVE

SEQ ID NO: 5979 - protein, 4 aa, Artificial Sequence
  Description of Artificial Sequence: Synthetic peptide
GTVK

SEQ ID NO: 5980 - protein, 4 aa, Artificial Sequence
  Description of Artificial Sequence: Synthetic peptide
LTVK

SEQ ID NO: 5981 - protein, 4 aa, Artificial Sequence
  Description of Artificial Sequence: Synthetic peptide
ITVK

SEQ ID NO: 5982 - protein, 4 aa, Artificial Sequence
  Description of Artificial Sequence: Synthetic peptide
RTVE

SEQ ID NO: 5983 - protein, 4 aa, Artificial Sequence
  Description of Artificial Sequence: Synthetic peptide
LTVT

SEQ ID NO: 5984 - protein, 4 aa, Artificial Sequence
  Description of Artificial Sequence: Synthetic peptide
TTVA

SEQ ID NO: 5985 - protein, 4 aa, Artificial Sequence
  Description of Artificial Sequence: Synthetic peptide
PTVK

SEQ ID NO: 5986 - protein, 4 aa, Artificial Sequence
  Description of Artificial Sequence: Synthetic peptide
GTVT

SEQ ID NO: 5987 - protein, 4 aa, Artificial Sequence
  Description of Artificial Sequence: Synthetic peptide
SSSA

SEQ ID NO: 5988 - protein, 4 aa, Artificial Sequence
  Description of Artificial Sequence: Synthetic peptide
SSSL

SEQ ID NO: 5989 - protein, 4 aa, Artificial Sequence
  Description of Artificial Sequence: Synthetic peptide
SSSR

SEQ ID NO: 5990 - protein, 4 aa, Artificial Sequence
  Description of Artificial Sequence: Synthetic peptide
SSSV

SEQ ID NO: 5991 - protein, 4 aa, Artificial Sequence
  Description of Artificial Sequence: Synthetic peptide
SSST

SEQ ID NO: 5992 - protein, 4 aa, Artificial Sequence
  Description of Artificial Sequence: Synthetic peptide
SSSM

SEQ ID NO: 5993 - protein, 4 aa, Artificial Sequence
  Description of Artificial Sequence: Synthetic peptide
SSSG

SEQ ID NO: 5994 - protein, 4 aa, Artificial Sequence
  Description of Artificial Sequence: Synthetic peptide
LSYG

SEQ ID NO: 5995 - protein, 4 aa, Artificial Sequence
  Description of Artificial Sequence: Synthetic peptide
PYYG

SEQ ID NO: 5996 - protein, 4 aa, Artificial Sequence
  Description of Artificial Sequence: Synthetic peptide
ASYG

SEQ ID NO: 5997 - protein, 4 aa, Artificial Sequence
  Description of Artificial Sequence: Synthetic peptide
FYYG

SEQ ID NO: 5998 - protein, 4 aa, Artificial Sequence
  Description of Artificial Sequence: Synthetic peptide
DSYG

SEQ ID NO: 5999 - protein, 4 aa, Artificial Sequence
  Description of Artificial Sequence: Synthetic peptide
VYYG

SEQ ID NO: 6000 - protein, 4 aa, Artificial Sequence
  Description of Artificial Sequence: Synthetic peptide
IYYG

SEQ ID NO: 6001 - protein, 4 aa, Artificial Sequence
  Description of Artificial Sequence: Synthetic peptide
DYYG

SEQ ID NO: 6002 - protein, 4 aa, Artificial Sequence
  Description of Artificial Sequence: Synthetic peptide
HYYG

SEQ ID NO: 6003 - protein, 4 aa, Artificial Sequence
  Description of Artificial Sequence: Synthetic peptide
SYYG

SEQ ID NO: 6004 - protein, 4 aa, Artificial Sequence
  Description of Artificial Sequence: Synthetic peptide
VSYG

SEQ ID NO: 6005 - protein, 4 aa, Artificial Sequence
  Description of Artificial Sequence: Synthetic peptide
NSYG

SEQ ID NO: 6006 - protein, 4 aa, Artificial Sequence
  Description of Artificial Sequence: Synthetic peptide
SSYG

SEQ ID NO: 6007 - protein, 4 aa, Artificial Sequence
  Description of Artificial Sequence: Synthetic peptide
FSYG

SEQ ID NO: 6008 - protein, 4 aa, Artificial Sequence
  Description of Artificial Sequence: Synthetic peptide
ISYG

SEQ ID NO: 6009 - protein, 4 aa, Artificial Sequence
  Description of Artificial Sequence: Synthetic peptide
TSYG

SEQ ID NO: 6010 - protein, 4 aa, Artificial Sequence
  Description of Artificial Sequence: Synthetic peptide
LYYG

SEQ ID NO: 6011 - protein, 4 aa, Artificial Sequence
  Description of Artificial Sequence: Synthetic peptide
PSYG

SEQ ID NO: 6012 - protein, 4 aa, Artificial Sequence
  Description of Artificial Sequence: Synthetic peptide
AYYG

SEQ ID NO: 6013 - protein, 4 aa, Artificial Sequence
  Description of Artificial Sequence: Synthetic peptide
HSYG

SEQ ID NO: 6014 - protein, 4 aa, Artificial Sequence
  Description of Artificial Sequence: Synthetic peptide
NYYG

SEQ ID NO: 6015 - protein, 4 aa, Artificial Sequence
  Description of Artificial Sequence: Synthetic peptide
TYYG

SEQ ID NO: 6016 - protein, 4 aa, Artificial Sequence
  Description of Artificial Sequence: Synthetic peptide
FSWY

SEQ ID NO: 6017 - protein, 4 aa, Artificial Sequence
  Description of Artificial Sequence: Synthetic peptide
SSWF

SEQ ID NO: 6018 - protein, 4 aa, Artificial Sequence
  Description of Artificial Sequence: Synthetic peptide
DSWS

SEQ ID NO: 6019 - protein, 4 aa, Artificial Sequence
  Description of Artificial Sequence: Synthetic peptide
LSWS

SEQ ID NO: 6020 - protein, 4 aa, Artificial Sequence
  Description of Artificial Sequence: Synthetic peptide
DSWY

SEQ ID NO: 6021 - protein, 4 aa, Artificial Sequence
  Description of Artificial Sequence: Synthetic peptide
LSWF

SEQ ID NO: 6022 - protein, 4 aa, Artificial Sequence
  Description of Artificial Sequence: Synthetic peptide
LSWY

SEQ ID NO: 6023 - protein, 4 aa, Artificial Sequence
  Description of Artificial Sequence: Synthetic peptide
VSWS

SEQ ID NO: 6024 - protein, 4 aa, Artificial Sequence
  Description of Artificial Sequence: Synthetic peptide
HSWY

SEQ ID NO: 6025 - protein, 4 aa, Artificial Sequence
  Description of Artificial Sequence: Synthetic peptide
SSWS

SEQ ID NO: 6026 - protein, 4 aa, Artificial Sequence
  Description of Artificial Sequence: Synthetic peptide
PSWS

SEQ ID NO: 6027 - protein, 4 aa, Artificial Sequence
  Description of Artificial Sequence: Synthetic peptide
FSWF

SEQ ID NO: 6028 - protein, 4 aa, Artificial Sequence
  Description of Artificial Sequence: Synthetic peptide
FSWS

SEQ ID NO: 6029 - protein, 4 aa, Artificial Sequence
  Description of Artificial Sequence: Synthetic peptide
PSWF

SEQ ID NO: 6030 - protein, 4 aa, Artificial Sequence
  Description of Artificial Sequence: Synthetic peptide
VSWF

SEQ ID NO: 6031 - protein, 4 aa, Artificial Sequence
  Description of Artificial Sequence: Synthetic peptide
HSWF

SEQ ID NO: 6032 - protein, 4 aa, Artificial Sequence
  Description of Artificial Sequence: Synthetic peptide
VSWY

SEQ ID NO: 6033 - protein, 4 aa, Artificial Sequence
  Description of Artificial Sequence: Synthetic peptide
HSWS

SEQ ID NO: 6034 - protein, 4 aa, Artificial Sequence
  Description of Artificial Sequence: Synthetic peptide
DSWF

SEQ ID NO: 6035 - protein, 4 aa, Artificial Sequence
  Description of Artificial Sequence: Synthetic peptide
PSWY

SEQ ID NO: 6036 - protein, 4 aa, Artificial Sequence
  Description of Artificial Sequence: Synthetic peptide
ASWY

SEQ ID NO: 6037 - protein, 4 aa, Artificial Sequence
  Description of Artificial Sequence: Synthetic peptide
YSWS

SEQ ID NO: 6038 - protein, 4 aa, Artificial Sequence
  Description of Artificial Sequence: Synthetic peptide
ASWF

SEQ ID NO: 6039 - protein, 4 aa, Artificial Sequence
  Description of Artificial Sequence: Synthetic peptide
ASWS

SEQ ID NO: 6040 - protein, 4 aa, Artificial Sequence
  Description of Artificial Sequence: Synthetic peptide
YSWF

SEQ ID NO: 6041 - protein, 4 aa, Artificial Sequence
  Description of Artificial Sequence: Synthetic peptide
YSWY

SEQ ID NO: 6042 - protein, 4 aa, Artificial Sequence
  Description of Artificial Sequence: Synthetic peptide
IQLV

SEQ ID NO: 6043 - protein, 4 aa, Artificial Sequence
  Description of Artificial Sequence: Synthetic peptide
AQLG

SEQ ID NO: 6044 - protein, 4 aa, Artificial Sequence
  Description of Artificial Sequence: Synthetic peptide
IQLA

SEQ ID NO: 6045 - protein, 4 aa, Artificial Sequence
  Description of Artificial Sequence: Synthetic peptide
EQLV

SEQ ID NO: 6046 - protein, 4 aa, Artificial Sequence
  Description of Artificial Sequence: Synthetic peptide
AQLA

SEQ ID NO: 6047 - protein, 4 aa, Artificial Sequence
  Description of Artificial Sequence: Synthetic peptide
IQLG

SEQ ID NO: 6048 - protein, 4 aa, Artificial Sequence
  Description of Artificial Sequence: Synthetic peptide
KQLD

SEQ ID NO: 6049 - protein, 4 aa, Artificial Sequence
  Description of Artificial Sequence: Synthetic peptide
TQLV

SEQ ID NO: 6050 - protein, 4 aa, Artificial Sequence
  Description of Artificial Sequence: Synthetic peptide
QQLA

SEQ ID NO: 6051 - protein, 4 aa, Artificial Sequence
  Description of Artificial Sequence: Synthetic peptide
AQLD

SEQ ID NO: 6052 - protein, 4 aa, Artificial Sequence
  Description of Artificial Sequence: Synthetic peptide
IQLD

SEQ ID NO: 6053 - protein, 4 aa, Artificial Sequence
  Description of Artificial Sequence: Synthetic peptide
AQLV

SEQ ID NO: 6054 - protein, 4 aa, Artificial Sequence
  Description of Artificial Sequence: Synthetic peptide
KQLA

SEQ ID NO: 6055 - protein, 4 aa, Artificial Sequence
  Description of Artificial Sequence: Synthetic peptide
KQLG

SEQ ID NO: 6056 - protein, 4 aa, Artificial Sequence
  Description of Artificial Sequence: Synthetic peptide
LQLD

SEQ ID NO: 6057 - protein, 4 aa, Artificial Sequence
  Description of Artificial Sequence: Synthetic peptide
LQLG

SEQ ID NO: 6058 - protein, 4 aa, Artificial Sequence
  Description of Artificial Sequence: Synthetic peptide
TQLA

SEQ ID NO: 6059 - protein, 4 aa, Artificial Sequence
  Description of Artificial Sequence: Synthetic peptide
VQLD

SEQ ID NO: 6060 - protein, 4 aa, Artificial Sequence
  Description of Artificial Sequence: Synthetic peptide
TQLD

SEQ ID NO: 6061 - protein, 4 aa, Artificial Sequence
  Description of Artificial Sequence: Synthetic peptide
VQLA

SEQ ID NO: 6062 - protein, 4 aa, Artificial Sequence
  Description of Artificial Sequence: Synthetic peptide
EQLD

SEQ ID NO: 6063 - protein, 4 aa, Artificial Sequence
  Description of Artificial Sequence: Synthetic peptide
VQLG

SEQ ID NO: 6064 - protein, 4 aa, Artificial Sequence
  Description of Artificial Sequence: Synthetic peptide
TQLG

SEQ ID NO: 6065 - protein, 4 aa, Artificial Sequence
  Description of Artificial Sequence: Synthetic peptide
PQLD

SEQ ID NO: 6066 - protein, 4 aa, Artificial Sequence
  Description of Artificial Sequence: Synthetic peptide
QQLD

SEQ ID NO: 6067 - protein, 4 aa, Artificial Sequence
  Description of Artificial Sequence: Synthetic peptide
PQLA

SEQ ID NO: 6068 - protein, 4 aa, Artificial Sequence
  Description of Artificial Sequence: Synthetic peptide
PQLG

SEQ ID NO: 6069 - protein, 4 aa, Artificial Sequence
  Description of Artificial Sequence: Synthetic peptide
VQLV

SEQ ID NO: 6070 - protein, 4 aa, Artificial Sequence
  Description of Artificial Sequence: Synthetic peptide
QQLG

SEQ ID NO: 6071 - protein, 4 aa, Artificial Sequence
  Description of Artificial Sequence: Synthetic peptide
KQLV

SEQ ID NO: 6072 - protein, 4 aa, Artificial Sequence
  Description of Artificial Sequence: Synthetic peptide
LQLV

SEQ ID NO: 6073 - protein, 4 aa, Artificial Sequence
  Description of Artificial Sequence: Synthetic peptide
LQLA

SEQ ID NO: 6074 - protein, 4 aa, Artificial Sequence
  Description of Artificial Sequence: Synthetic peptide
EQLA

SEQ ID NO: 6075 - protein, 4 aa, Artificial Sequence
  Description of Artificial Sequence: Synthetic peptide
PQLV

SEQ ID NO: 6076 - protein, 4 aa, Artificial Sequence
  Description of Artificial Sequence: Synthetic peptide
EQLG

SEQ ID NO: 6077 - protein, 4 aa, Artificial Sequence
  Description of Artificial Sequence: Synthetic peptide
DGSA

SEQ ID NO: 6078 - protein, 4 aa, Artificial Sequence
  Description of Artificial Sequence: Synthetic peptide
DGSS

SEQ ID NO: 6079 - protein, 4 aa, Artificial Sequence
  Description of Artificial Sequence: Synthetic peptide
SGSA

SEQ ID NO: 6080 - protein, 4 aa, Artificial Sequence
  Description of Artificial Sequence: Synthetic peptide
DGSD

SEQ ID NO: 6081 - protein, 4 aa, Artificial Sequence
  Description of Artificial Sequence: Synthetic peptide
SGSD

SEQ ID NO: 6082 - protein, 4 aa, Artificial Sequence
  Description of Artificial Sequence: Synthetic peptide
PGSD

SEQ ID NO: 6083 - protein, 4 aa, Artificial Sequence
  Description of Artificial Sequence: Synthetic peptide
FGSS

SEQ ID NO: 6084 - protein, 4 aa, Artificial Sequence
  Description of Artificial Sequence: Synthetic peptide
HGSA

SEQ ID NO: 6085 - protein, 4 aa, Artificial Sequence
  Description of Artificial Sequence: Synthetic peptide
YGSS

SEQ ID NO: 6086 - protein, 4 aa, Artificial Sequence
  Description of Artificial Sequence: Synthetic peptide
FGSA

SEQ ID NO: 6087 - protein, 4 aa, Artificial Sequence
  Description of Artificial Sequence: Synthetic peptide
FGSD

SEQ ID NO: 6088 - protein, 4 aa, Artificial Sequence
  Description of Artificial Sequence: Synthetic peptide
LGSA

SEQ ID NO: 6089 - protein, 4 aa, Artificial Sequence
  Description of Artificial Sequence: Synthetic peptide
LGSS

SEQ ID NO: 6090 - protein, 4 aa, Artificial Sequence
  Description of Artificial Sequence: Synthetic peptide
AGSD

SEQ ID NO: 6091 - protein, 4 aa, Artificial Sequence
  Description of Artificial Sequence: Synthetic peptide
VGSS

SEQ ID NO: 6092 - protein, 4 aa, Artificial Sequence
  Description of Artificial Sequence: Synthetic peptide
AGSS

SEQ ID NO: 6093 - protein, 4 aa, Artificial Sequence
  Description of Artificial Sequence: Synthetic peptide
HGSD

SEQ ID NO: 6094 - protein, 4 aa, Artificial Sequence
  Description of Artificial Sequence: Synthetic peptide
VGSA

SEQ ID NO: 6095 - protein, 4 aa, Artificial Sequence
  Description of Artificial Sequence: Synthetic peptide
YGSA

SEQ ID NO: 6096 - protein, 4 aa, Artificial Sequence
  Description of Artificial Sequence: Synthetic peptide
YGSD

SEQ ID NO: 6097 - protein, 4 aa, Artificial Sequence
  Description of Artificial Sequence: Synthetic peptide
AGSA

SEQ ID NO: 6098 - protein, 4 aa, Artificial Sequence
  Description of Artificial Sequence: Synthetic peptide
HGSS

SEQ ID NO: 6099 - protein, 4 aa, Artificial Sequence
  Description of Artificial Sequence: Synthetic peptide
VGSD

SEQ ID NO: 6100 - protein, 4 aa, Artificial Sequence
  Description of Artificial Sequence: Synthetic peptide
PGSA

SEQ ID NO: 6101 - protein, 4 aa, Artificial Sequence
  Description of Artificial Sequence: Synthetic peptide
PGSS

SEQ ID NO: 6102 - protein, 4 aa, Artificial Sequence
  Description of Artificial Sequence: Synthetic peptide
SGSS

SEQ ID NO: 6103 - protein, 4 aa, Artificial Sequence
  Description of Artificial Sequence: Synthetic peptide
LGSD

SEQ ID NO: 6104 - protein, 4 aa, Artificial Sequence
  Description of Artificial Sequence: Synthetic peptide
PGWY

SEQ ID NO: 6105 - protein, 4 aa, Artificial Sequence
  Description of Artificial Sequence: Synthetic peptide
FGWY

SEQ ID NO: 6106 - protein, 4 aa, Artificial Sequence
  Description of Artificial Sequence: Synthetic peptide
YGWY

SEQ ID NO: 6107 - protein, 4 aa, Artificial Sequence
  Description of Artificial Sequence: Synthetic peptide
AGWY

SEQ ID NO: 6108 - protein, 4 aa, Artificial Sequence
  Description of Artificial Sequence: Synthetic peptide
VGWY

SEQ ID NO: 6109 - protein, 4 aa, Artificial Sequence
  Description of Artificial Sequence: Synthetic peptide
LGWY

SEQ ID NO: 6110 - protein, 4 aa, Artificial Sequence
  Description of Artificial Sequence: Synthetic peptide
DGWY

SEQ ID NO: 6111 - protein, 4 aa, Artificial Sequence
  Description of Artificial Sequence: Synthetic peptide
HGWY

SEQ ID NO: 6112 - protein, 4 aa, Artificial Sequence
  Description of Artificial Sequence: Synthetic peptide
PSGW

SEQ ID NO: 6113 - protein, 4 aa, Artificial Sequence
  Description of Artificial Sequence: Synthetic peptide
YSGW

SEQ ID NO: 6114 - protein, 4 aa, Artificial Sequence
  Description of Artificial Sequence: Synthetic peptide
FSGR

SEQ ID NO: 6115 - protein, 4 aa, Artificial Sequence
  Description of Artificial Sequence: Synthetic peptide
VSGG

SEQ ID NO: 6116 - protein, 4 aa, Artificial Sequence
  Description of Artificial Sequence: Synthetic peptide
NSGR

SEQ ID NO: 6117 - protein, 4 aa, Artificial Sequence
  Description of Artificial Sequence: Synthetic peptide
DSGR

SEQ ID NO: 6118 - protein, 4 aa, Artificial Sequence
  Description of Artificial Sequence: Synthetic peptide
ASGR

SEQ ID NO: 6119 - protein, 4 aa, Artificial Sequence
  Description of Artificial Sequence: Synthetic peptide
FSGW

SEQ ID NO: 6120 - protein, 4 aa, Artificial Sequence
  Description of Artificial Sequence: Synthetic peptide
DSGW

SEQ ID NO: 6121 - protein, 4 aa, Artificial Sequence
  Description of Artificial Sequence: Synthetic peptide
VSGR

SEQ ID NO: 6122 - protein, 4 aa, Artificial Sequence
  Description of Artificial Sequence: Synthetic peptide
ISGW

SEQ ID NO: 6123 - protein, 4 aa, Artificial Sequence
  Description of Artificial Sequence: Synthetic peptide
LSGW

SEQ ID NO: 6124 - protein, 4 aa, Artificial Sequence
  Description of Artificial Sequence: Synthetic peptide
HSGR

SEQ ID NO: 6125 - protein, 4 aa, Artificial Sequence
  Description of Artificial Sequence: Synthetic peptide
NSGW

SEQ ID NO: 6126 - protein, 4 aa, Artificial Sequence
  Description of Artificial Sequence: Synthetic peptide
HSGG

SEQ ID NO: 6127 - protein, 4 aa, Artificial Sequence
  Description of Artificial Sequence: Synthetic peptide
HSGW

SEQ ID NO: 6128 - protein, 4 aa, Artificial Sequence
  Description of Artificial Sequence: Synthetic peptide
ISGG

SEQ ID NO: 6129 - protein, 4 aa, Artificial Sequence
  Description of Artificial Sequence: Synthetic peptide
YSGR

SEQ ID NO: 6130 - protein, 4 aa, Artificial Sequence
  Description of Artificial Sequence: Synthetic peptide
ISGR

SEQ ID NO: 6131 - protein, 4 aa, Artificial Sequence
  Description of Artificial Sequence: Synthetic peptide
YSGG

SEQ ID NO: 6132 - protein, 4 aa, Artificial Sequence
  Description of Artificial Sequence: Synthetic peptide
NSGG

SEQ ID NO: 6133 - protein, 4 aa, Artificial Sequence
  Description of Artificial Sequence: Synthetic peptide
VSGW

SEQ ID NO: 6134 - protein, 4 aa, Artificial Sequence
  Description of Artificial Sequence: Synthetic peptide
SSGR

SEQ ID NO: 6135 - protein, 4 aa, Artificial Sequence
  Description of Artificial Sequence: Synthetic peptide
LSGR

SEQ ID NO: 6136 - protein, 4 aa, Artificial Sequence
  Description of Artificial Sequence: Synthetic peptide
PSGR

SEQ ID NO: 6137 - protein, 4 aa, Artificial Sequence
  Description of Artificial Sequence: Synthetic peptide
FSGG

SEQ ID NO: 6138 - protein, 4 aa, Artificial Sequence
  Description of Artificial Sequence: Synthetic peptide
TSGR

SEQ ID NO: 6139 - protein, 4 aa, Artificial Sequence
  Description of Artificial Sequence: Synthetic peptide
TSGW

SEQ ID NO: 6140 - protein, 4 aa, Artificial Sequence
  Description of Artificial Sequence: Synthetic peptide
ASGG

SEQ ID NO: 6141 - protein, 4 aa, Artificial Sequence
  Description of Artificial Sequence: Synthetic peptide
LSGG

SEQ ID NO: 6142 - protein, 4 aa, Artificial Sequence
  Description of Artificial Sequence: Synthetic peptide
ASGW

SEQ ID NO: 6143 - protein, 4 aa, Artificial Sequence
  Description of Artificial Sequence: Synthetic peptide
PSGG

SEQ ID NO: 6144 - protein, 4 aa, Artificial Sequence
  Description of Artificial Sequence: Synthetic peptide
TSGG

SEQ ID NO: 6145 - protein, 4 aa, Artificial Sequence
  Description of Artificial Sequence: Synthetic peptide
SSGG

SEQ ID NO: 6146 - protein, 4 aa, Artificial Sequence
  Description of Artificial Sequence: Synthetic peptide
VGYD

SEQ ID NO: 6147 - protein, 4 aa, Artificial Sequence
  Description of Artificial Sequence: Synthetic peptide
AGYD

SEQ ID NO: 6148 - protein, 4 aa, Artificial Sequence
  Description of Artificial Sequence: Synthetic peptide
DGYD

SEQ ID NO: 6149 - protein, 4 aa, Artificial Sequence
  Description of Artificial Sequence: Synthetic peptide
AGYA

SEQ ID NO: 6150 - protein, 4 aa, Artificial Sequence
  Description of Artificial Sequence: Synthetic peptide
DGYA

SEQ ID NO: 6151 - protein, 4 aa, Artificial Sequence
  Description of Artificial Sequence: Synthetic peptide
FGYA

SEQ ID NO: 6152 - protein, 4 aa, Artificial Sequence
  Description of Artificial Sequence: Synthetic peptide
FGYD

SEQ ID NO: 6153 - protein, 4 aa, Artificial Sequence
  Description of Artificial Sequence: Synthetic peptide
PGYA

SEQ ID NO: 6154 - protein, 4 aa, Artificial Sequence
  Description of Artificial Sequence: Synthetic peptide
DGYS

SEQ ID NO: 6155 - protein, 4 aa, Artificial Sequence
  Description of Artificial Sequence: Synthetic peptide
YGYA

SEQ ID NO: 6156 - protein, 4 aa, Artificial Sequence
  Description of Artificial Sequence: Synthetic peptide
FGYS

SEQ ID NO: 6157 - protein, 4 aa, Artificial Sequence
  Description of Artificial Sequence: Synthetic peptide
VGYA

SEQ ID NO: 6158 - protein, 4 aa, Artificial Sequence
  Description of Artificial Sequence: Synthetic peptide
PGYD

SEQ ID NO: 6159 - protein, 4 aa, Artificial Sequence
  Description of Artificial Sequence: Synthetic peptide
PGYS

SEQ ID NO: 6160 - protein, 4 aa, Artificial Sequence
  Description of Artificial Sequence: Synthetic peptide
VGYS

SEQ ID NO: 6161 - protein, 4 aa, Artificial Sequence
  Description of Artificial Sequence: Synthetic peptide
YGYD

SEQ ID NO: 6162 - protein, 4 aa, Artificial Sequence
  Description of Artificial Sequence: Synthetic peptide
HGYA

SEQ ID NO: 6163 - protein, 4 aa, Artificial Sequence
  Description of Artificial Sequence: Synthetic peptide
YGYS

SEQ ID NO: 6164 - protein, 4 aa, Artificial Sequence
  Description of Artificial Sequence: Synthetic peptide
HGYD

SEQ ID NO: 6165 - protein, 4 aa, Artificial Sequence
  Description of Artificial Sequence: Synthetic peptide
SGYS

SEQ ID NO: 6166 - protein, 4 aa, Artificial Sequence
  Description of Artificial Sequence: Synthetic peptide
LGYA

SEQ ID NO: 6167 - protein, 4 aa, Artificial Sequence
  Description of Artificial Sequence: Synthetic peptide
HGYS

SEQ ID NO: 6168 - protein, 4 aa, Artificial Sequence
  Description of Artificial Sequence: Synthetic peptide
LGYD

SEQ ID NO: 6169 - protein, 4 aa, Artificial Sequence
  Description of Artificial Sequence: Synthetic peptide
AGYS

SEQ ID NO: 6170 - protein, 4 aa, Artificial Sequence
  Description of Artificial Sequence: Synthetic peptide
LGYS

SEQ ID NO: 6171 - protein, 4 aa, Artificial Sequence
  Description of Artificial Sequence: Synthetic peptide
SGYA

SEQ ID NO: 6172 - protein, 4 aa, Artificial Sequence
  Description of Artificial Sequence: Synthetic peptide
QVTA

SEQ ID NO: 6173 - protein, 4 aa, Artificial Sequence
  Description of Artificial Sequence: Synthetic peptide
PVTA

SEQ ID NO: 6174 - protein, 4 aa, Artificial Sequence
  Description of Artificial Sequence: Synthetic peptide
LVTT

SEQ ID NO: 6175 - protein, 4 aa, Artificial Sequence
  Description of Artificial Sequence: Synthetic peptide
PVTT

SEQ ID NO: 6176 - protein, 4 aa, Artificial Sequence
  Description of Artificial Sequence: Synthetic peptide
PVTE

SEQ ID NO: 6177 - protein, 4 aa, Artificial Sequence
  Description of Artificial Sequence: Synthetic peptide
QVTT

SEQ ID NO: 6178 - protein, 4 aa, Artificial Sequence
  Description of Artificial Sequence: Synthetic peptide
AVTA

SEQ ID NO: 6179 - protein, 4 aa, Artificial Sequence
  Description of Artificial Sequence: Synthetic peptide
QVTK

SEQ ID NO: 6180 - protein, 4 aa, Artificial Sequence
  Description of Artificial Sequence: Synthetic peptide
IVTA

SEQ ID NO: 6181 - protein, 4 aa, Artificial Sequence
  Description of Artificial Sequence: Synthetic peptide
PVTK

SEQ ID NO: 6182 - protein, 4 aa, Artificial Sequence
  Description of Artificial Sequence: Synthetic peptide
LVTK

SEQ ID NO: 6183 - protein, 4 aa, Artificial Sequence
  Description of Artificial Sequence: Synthetic peptide
AVTE

SEQ ID NO: 6184 - protein, 4 aa, Artificial Sequence
  Description of Artificial Sequence: Synthetic peptide
LVTA

SEQ ID NO: 6185 - protein, 4 aa, Artificial Sequence
  Description of Artificial Sequence: Synthetic peptide
EVTA

SEQ ID NO: 6186 - protein, 4 aa, Artificial Sequence
  Description of Artificial Sequence: Synthetic peptide
LVTE

SEQ ID NO: 6187 - protein, 4 aa, Artificial Sequence
  Description of Artificial Sequence: Synthetic peptide
EVTE

SEQ ID NO: 6188 - protein, 4 aa, Artificial Sequence
  Description of Artificial Sequence: Synthetic peptide
IVTE

SEQ ID NO: 6189 - protein, 4 aa, Artificial Sequence
  Description of Artificial Sequence: Synthetic peptide
TVTK

SEQ ID NO: 6190 - protein, 4 aa, Artificial Sequence
  Description of Artificial Sequence: Synthetic peptide
IVTT

SEQ ID NO: 6191 - protein, 4 aa, Artificial Sequence
  Description of Artificial Sequence: Synthetic peptide
VVTE

SEQ ID NO: 6192 - protein, 4 aa, Artificial Sequence
  Description of Artificial Sequence: Synthetic peptide
IVTK

SEQ ID NO: 6193 - protein, 4 aa, Artificial Sequence
  Description of Artificial Sequence: Synthetic peptide
TVTE

SEQ ID NO: 6194 - protein, 4 aa, Artificial Sequence
  Description of Artificial Sequence: Synthetic peptide
AVTT

SEQ ID NO: 6195 - protein, 4 aa, Artificial Sequence
  Description of Artificial Sequence: Synthetic peptide
KVTA

SEQ ID NO: 6196 - protein, 4 aa, Artificial Sequence
  Description of Artificial Sequence: Synthetic peptide
KVTE

SEQ ID NO: 6197 - protein, 4 aa, Artificial Sequence
  Description of Artificial Sequence: Synthetic peptide
AVTK

SEQ ID NO: 6198 - protein, 4 aa, Artificial Sequence
  Description of Artificial Sequence: Synthetic peptide
EVTK

SEQ ID NO: 6199 - protein, 4 aa, Artificial Sequence
  Description of Artificial Sequence: Synthetic peptide
KVTK

SEQ ID NO: 6200 - protein, 4 aa, Artificial Sequence
  Description of Artificial Sequence: Synthetic peptide
VVTK

SEQ ID NO: 6201 - protein, 4 aa, Artificial Sequence
  Description of Artificial Sequence: Synthetic peptide
TVTA

SEQ ID NO: 6202 - protein, 4 aa, Artificial Sequence
  Description of Artificial Sequence: Synthetic peptide
QVTE

SEQ ID NO: 6203 - protein, 4 aa, Artificial Sequence
  Description of Artificial Sequence: Synthetic peptide
VVTT

SEQ ID NO: 6204 - protein, 4 aa, Artificial Sequence
  Description of Artificial Sequence: Synthetic peptide
EVTT

SEQ ID NO: 6205 - protein, 4 aa, Artificial Sequence
  Description of Artificial Sequence: Synthetic peptide
KVTT

SEQ ID NO: 6206 - protein, 4 aa, Artificial Sequence
  Description of Artificial Sequence: Synthetic peptide
AAAS

SEQ ID NO: 6207 - protein, 4 aa, Artificial Sequence
  Description of Artificial Sequence: Synthetic peptide
AAAL

SEQ ID NO: 6208 - protein, 4 aa, Artificial Sequence
  Description of Artificial Sequence: Synthetic peptide
AAAR

SEQ ID NO: 6209 - protein, 4 aa, Artificial Sequence
  Description of Artificial Sequence: Synthetic peptide
AAAI

SEQ ID NO: 6210 - protein, 4 aa, Artificial Sequence
  Description of Artificial Sequence: Synthetic peptide
AAAV

SEQ ID NO: 6211 - protein, 4 aa, Artificial Sequence
  Description of Artificial Sequence: Synthetic peptide
AAAP

SEQ ID NO: 6212 - protein, 4 aa, Artificial Sequence
  Description of Artificial Sequence: Synthetic peptide
AAAA

SEQ ID NO: 6213 - protein, 4 aa, Artificial Sequence
  Description of Artificial Sequence: Synthetic peptide
AIFG

SEQ ID NO: 6214 - protein, 4 aa, Artificial Sequence
  Description of Artificial Sequence: Synthetic peptide
ATFG

SEQ ID NO: 6215 - protein, 4 aa, Artificial Sequence
  Description of Artificial Sequence: Synthetic peptide
PTFG

SEQ ID NO: 6216 - protein, 4 aa, Artificial Sequence
  Description of Artificial Sequence: Synthetic peptide
TTFG

SEQ ID NO: 6217 - protein, 4 aa, Artificial Sequence
  Description of Artificial Sequence: Synthetic peptide
RTFG

SEQ ID NO: 6218 - protein, 4 aa, Artificial Sequence
  Description of Artificial Sequence: Synthetic peptide
STFG

SEQ ID NO: 6219 - protein, 4 aa, Artificial Sequence
  Description of Artificial Sequence: Synthetic peptide
SIFG

SEQ ID NO: 6220 - protein, 4 aa, Artificial Sequence
  Description of Artificial Sequence: Synthetic peptide
LIFG

SEQ ID NO: 6221 - protein, 4 aa, Artificial Sequence
  Description of Artificial Sequence: Synthetic peptide
RIFG

SEQ ID NO: 6222 - protein, 4 aa, Artificial Sequence
  Description of Artificial Sequence: Synthetic peptide
GIFG

SEQ ID NO: 6223 - protein, 4 aa, Artificial Sequence
  Description of Artificial Sequence: Synthetic peptide
IIFG

SEQ ID NO: 6224 - protein, 4 aa, Artificial Sequence
  Description of Artificial Sequence: Synthetic peptide
LTFG

SEQ ID NO: 6225 - protein, 4 aa, Artificial Sequence
  Description of Artificial Sequence: Synthetic peptide
VIFG

SEQ ID NO: 6226 - protein, 4 aa, Artificial Sequence
  Description of Artificial Sequence: Synthetic peptide
PIFG

SEQ ID NO: 6227 - protein, 4 aa, Artificial Sequence
  Description of Artificial Sequence: Synthetic peptide
GTFG

SEQ ID NO: 6228 - protein, 4 aa, Artificial Sequence
  Description of Artificial Sequence: Synthetic peptide
VTFG

SEQ ID NO: 6229 - protein, 4 aa, Artificial Sequence
  Description of Artificial Sequence: Synthetic peptide
VAAK

SEQ ID NO: 6230 - protein, 4 aa, Artificial Sequence
  Description of Artificial Sequence: Synthetic peptide
VAAL

SEQ ID NO: 6231 - protein, 4 aa, Artificial Sequence
  Description of Artificial Sequence: Synthetic peptide
VAAP

SEQ ID NO: 6232 - protein, 4 aa, Artificial Sequence
  Description of Artificial Sequence: Synthetic peptide
VAAQ

SEQ ID NO: 6233 - protein, 4 aa, Artificial Sequence
  Description of Artificial Sequence: Synthetic peptide
VAAA

SEQ ID NO: 6234 - protein, 4 aa, Artificial Sequence
  Description of Artificial Sequence: Synthetic peptide
VAAE

SEQ ID NO: 6235 - protein, 4 aa, Artificial Sequence
  Description of Artificial Sequence: Synthetic peptide
VAAV

SEQ ID NO: 6236 - protein, 4 aa, Artificial Sequence
  Description of Artificial Sequence: Synthetic peptide
VAAI

SEQ ID NO: 6237 - protein, 4 aa, Artificial Sequence
  Description of Artificial Sequence: Synthetic peptide
VYYA

SEQ ID NO: 6238 - protein, 4 aa, Artificial Sequence
  Description of Artificial Sequence: Synthetic peptide
AYYD

SEQ ID NO: 6239 - protein, 4 aa, Artificial Sequence
  Description of Artificial Sequence: Synthetic peptide
YYYA

SEQ ID NO: 6240 - protein, 4 aa, Artificial Sequence
  Description of Artificial Sequence: Synthetic peptide
PYYD

SEQ ID NO: 6241 - protein, 4 aa, Artificial Sequence
  Description of Artificial Sequence: Synthetic peptide
IYYD

SEQ ID NO: 6242 - protein, 4 aa, Artificial Sequence
  Description of Artificial Sequence: Synthetic peptide
VYYD

SEQ ID NO: 6243 - protein, 4 aa, Artificial Sequence
  Description of Artificial Sequence: Synthetic peptide
IYYA

SEQ ID NO: 6244 - protein, 4 aa, Artificial Sequence
  Description of Artificial Sequence: Synthetic peptide
TYYA

SEQ ID NO: 6245 - protein, 4 aa, Artificial Sequence
  Description of Artificial Sequence: Synthetic peptide
LYYD

SEQ ID NO: 6246 - protein, 4 aa, Artificial Sequence
  Description of Artificial Sequence: Synthetic peptide
DYYD

SEQ ID NO: 6247 - protein, 4 aa, Artificial Sequence
  Description of Artificial Sequence: Synthetic peptide
SYYD

SEQ ID NO: 6248 - protein, 4 aa, Artificial Sequence
  Description of Artificial Sequence: Synthetic peptide
LYYA

SEQ ID NO: 6249 - protein, 4 aa, Artificial Sequence
  Description of Artificial Sequence: Synthetic peptide
HYYA

SEQ ID NO: 6250 - protein, 4 aa, Artificial Sequence
  Description of Artificial Sequence: Synthetic peptide
DYYA

SEQ ID NO: 6251 - protein, 4 aa, Artificial Sequence
  Description of Artificial Sequence: Synthetic peptide
SYYA

SEQ ID NO: 6252 - protein, 4 aa, Artificial Sequence
  Description of Artificial Sequence: Synthetic peptide
FYYD

SEQ ID NO: 6253 - protein, 4 aa, Artificial Sequence
  Description of Artificial Sequence: Synthetic peptide
FYYA

SEQ ID NO: 6254 - protein, 4 aa, Artificial Sequence
  Description of Artificial Sequence: Synthetic peptide
PYYA

SEQ ID NO: 6255 - protein, 4 aa, Artificial Sequence
  Description of Artificial Sequence: Synthetic peptide
AYYA

SEQ ID NO: 6256 - protein, 4 aa, Artificial Sequence
  Description of Artificial Sequence: Synthetic peptide
HYYD

SEQ ID NO: 6257 - protein, 4 aa, Artificial Sequence
  Description of Artificial Sequence: Synthetic peptide
NYYA

SEQ ID NO: 6258 - protein, 4 aa, Artificial Sequence
  Description of Artificial Sequence: Synthetic peptide
TYYD

SEQ ID NO: 6259 - protein, 4 aa, Artificial Sequence
  Description of Artificial Sequence: Synthetic peptide
NYYD

SEQ ID NO: 6260 - protein, 4 aa, Artificial Sequence
  Description of Artificial Sequence: Synthetic peptide
GYGY

SEQ ID NO: 6261 - protein, 4 aa, Artificial Sequence
  Description of Artificial Sequence: Synthetic peptide
LYGY

SEQ ID NO: 6262 - protein, 4 aa, Artificial Sequence
  Description of Artificial Sequence: Synthetic peptide
RYGY

SEQ ID NO: 6263 - protein, 4 aa, Artificial Sequence
  Description of Artificial Sequence: Synthetic peptide
TYGY

SEQ ID NO: 6264 - protein, 4 aa, Artificial Sequence
  Description of Artificial Sequence: Synthetic peptide
TSGY

SEQ ID NO: 6265 - protein, 4 aa, Artificial Sequence
  Description of Artificial Sequence: Synthetic peptide
VYGY

SEQ ID NO: 6266 - protein, 4 aa, Artificial Sequence
  Description of Artificial Sequence: Synthetic peptide
ISGY

SEQ ID NO: 6267 - protein, 4 aa, Artificial Sequence
  Description of Artificial Sequence: Synthetic peptide
ASGY

SEQ ID NO: 6268 - protein, 4 aa, Artificial Sequence
  Description of Artificial Sequence: Synthetic peptide
PSGY

SEQ ID NO: 6269 - protein, 4 aa, Artificial Sequence
  Description of Artificial Sequence: Synthetic peptide
RSGY

SEQ ID NO: 6270 - protein, 4 aa, Artificial Sequence
  Description of Artificial Sequence: Synthetic peptide
GAGY

SEQ ID NO: 6271 - protein, 4 aa, Artificial Sequence
  Description of Artificial Sequence: Synthetic peptide
AAGY

SEQ ID NO: 6272 - protein, 4 aa, Artificial Sequence
  Description of Artificial Sequence: Synthetic peptide
LSGY

SEQ ID NO: 6273 - protein, 4 aa, Artificial Sequence
  Description of Artificial Sequence: Synthetic peptide
VSGY

SEQ ID NO: 6274 - protein, 4 aa, Artificial Sequence
  Description of Artificial Sequence: Synthetic peptide
VAGY

SEQ ID NO: 6275 - protein, 4 aa, Artificial Sequence
  Description of Artificial Sequence: Synthetic peptide
TAGY

SEQ ID NO: 6276 - protein, 4 aa, Artificial Sequence
  Description of Artificial Sequence: Synthetic peptide
PAGY

SEQ ID NO: 6277 - protein, 4 aa, Artificial Sequence
  Description of Artificial Sequence: Synthetic peptide
SAGY

SEQ ID NO: 6278 - protein, 4 aa, Artificial Sequence
  Description of Artificial Sequence: Synthetic peptide
RAGY

SEQ ID NO: 6279 - protein, 4 aa, Artificial Sequence
  Description of Artificial Sequence: Synthetic peptide
IAGY

SEQ ID NO: 6280 - protein, 4 aa, Artificial Sequence
  Description of Artificial Sequence: Synthetic peptide
AYGY

SEQ ID NO: 6281 - protein, 4 aa, Artificial Sequence
  Description of Artificial Sequence: Synthetic peptide
PYGY

SEQ ID NO: 6282 - protein, 4 aa, Artificial Sequence
  Description of Artificial Sequence: Synthetic peptide
LAGY

SEQ ID NO: 6283 - protein, 4 aa, Artificial Sequence
  Description of Artificial Sequence: Synthetic peptide
IYGY

SEQ ID NO: 6284 - protein, 4 aa, Artificial Sequence
  Description of Artificial Sequence: Synthetic peptide
GSGY

SEQ ID NO: 6285 - protein, 4 aa, Artificial Sequence
  Description of Artificial Sequence: Synthetic peptide
LQLL

SEQ ID NO: 6286 - protein, 4 aa, Artificial Sequence
  Description of Artificial Sequence: Synthetic peptide
AQLW

SEQ ID NO: 6287 - protein, 4 aa, Artificial Sequence
  Description of Artificial Sequence: Synthetic peptide
TQLW

SEQ ID NO: 6288 - protein, 4 aa, Artificial Sequence
  Description of Artificial Sequence: Synthetic peptide
QQLL

SEQ ID NO: 6289 - protein, 4 aa, Artificial Sequence
  Description of Artificial Sequence: Synthetic peptide
EQLL

SEQ ID NO: 6290 - protein, 4 aa, Artificial Sequence
  Description of Artificial Sequence: Synthetic peptide
QQLW

SEQ ID NO: 6291 - protein, 4 aa, Artificial Sequence
  Description of Artificial Sequence: Synthetic peptide
IQLL

SEQ ID NO: 6292 - protein, 4 aa, Artificial Sequence
  Description of Artificial Sequence: Synthetic peptide
EQLW

SEQ ID NO: 6293 - protein, 4 aa, Artificial Sequence
  Description of Artificial Sequence: Synthetic peptide
VQLW

SEQ ID NO: 6294 - protein, 4 aa, Artificial Sequence
  Description of Artificial Sequence: Synthetic peptide
KQLW

SEQ ID NO: 6295 - protein, 4 aa, Artificial Sequence
  Description of Artificial Sequence: Synthetic peptide
KQLL

SEQ ID NO: 6296 - protein, 4 aa, Artificial Sequence
  Description of Artificial Sequence: Synthetic peptide
PQLW

SEQ ID NO: 6297 - protein, 4 aa, Artificial Sequence
  Description of Artificial Sequence: Synthetic peptide
VQLL

SEQ ID NO: 6298 - protein, 4 aa, Artificial Sequence
  Description of Artificial Sequence: Synthetic peptide
TQLL

SEQ ID NO: 6299 - protein, 4 aa, Artificial Sequence
  Description of Artificial Sequence: Synthetic peptide
PQLL

SEQ ID NO: 6300 - protein, 4 aa, Artificial Sequence
  Description of Artificial Sequence: Synthetic peptide
LQLW

SEQ ID NO: 6301 - protein, 4 aa, Artificial Sequence
  Description of Artificial Sequence: Synthetic peptide
AQLL

SEQ ID NO: 6302 - protein, 4 aa, Artificial Sequence
  Description of Artificial Sequence: Synthetic peptide
LGVA

SEQ ID NO: 6303 - protein, 4 aa, Artificial Sequence
  Description of Artificial Sequence: Synthetic peptide
LGGA

SEQ ID NO: 6304 - protein, 4 aa, Artificial Sequence
  Description of Artificial Sequence: Synthetic peptide
KGIA

SEQ ID NO: 6305 - protein, 4 aa, Artificial Sequence
  Description of Artificial Sequence: Synthetic peptide
KGSA

SEQ ID NO: 6306 - protein, 4 aa, Artificial Sequence
  Description of Artificial Sequence: Synthetic peptide
VGIA

SEQ ID NO: 6307 - protein, 4 aa, Artificial Sequence
  Description of Artificial Sequence: Synthetic peptide
KGGA

SEQ ID NO: 6308 - protein, 4 aa, Artificial Sequence
  Description of Artificial Sequence: Synthetic peptide
MGGA

SEQ ID NO: 6309 - protein, 4 aa, Artificial Sequence
  Description of Artificial Sequence: Synthetic peptide
TGGA

SEQ ID NO: 6310 - protein, 4 aa, Artificial Sequence
  Description of Artificial Sequence: Synthetic peptide
QGSA

SEQ ID NO: 6311 - protein, 4 aa, Artificial Sequence
  Description of Artificial Sequence: Synthetic peptide
QGIA

SEQ ID NO: 6312 - protein, 4 aa, Artificial Sequence
  Description of Artificial Sequence: Synthetic peptide
EGSA

SEQ ID NO: 6313 - protein, 4 aa, Artificial Sequence
  Description of Artificial Sequence: Synthetic peptide
PGVA

SEQ ID NO: 6314 - protein, 4 aa, Artificial Sequence
  Description of Artificial Sequence: Synthetic peptide
QGVA

SEQ ID NO: 6315 - protein, 4 aa, Artificial Sequence
  Description of Artificial Sequence: Synthetic peptide
EGIA

SEQ ID NO: 6316 - protein, 4 aa, Artificial Sequence
  Description of Artificial Sequence: Synthetic peptide
AGVA

SEQ ID NO: 6317 - protein, 4 aa, Artificial Sequence
  Description of Artificial Sequence: Synthetic peptide
MGVA

SEQ ID NO: 6318 - protein, 4 aa, Artificial Sequence
  Description of Artificial Sequence: Synthetic peptide
PGIA

SEQ ID NO: 6319 - protein, 4 aa, Artificial Sequence
  Description of Artificial Sequence: Synthetic peptide
AGGA

SEQ ID NO: 6320 - protein, 4 aa, Artificial Sequence
  Description of Artificial Sequence: Synthetic peptide
VGGA

SEQ ID NO: 6321 - protein, 4 aa, Artificial Sequence
  Description of Artificial Sequence: Synthetic peptide
EGVA

SEQ ID NO: 6322 - protein, 4 aa, Artificial Sequence
  Description of Artificial Sequence: Synthetic peptide
PGGA

SEQ ID NO: 6323 - protein, 4 aa, Artificial Sequence
  Description of Artificial Sequence: Synthetic peptide
QGGA

SEQ ID NO: 6324 - protein, 4 aa, Artificial Sequence
  Description of Artificial Sequence: Synthetic peptide
AGIA

SEQ ID NO: 6325 - protein, 4 aa, Artificial Sequence
  Description of Artificial Sequence: Synthetic peptide
LGIA

SEQ ID NO: 6326 - protein, 4 aa, Artificial Sequence
  Description of Artificial Sequence: Synthetic peptide
MGIA

SEQ ID NO: 6327 - protein, 4 aa, Artificial Sequence
  Description of Artificial Sequence: Synthetic peptide
TGSA

SEQ ID NO: 6328 - protein, 4 aa, Artificial Sequence
  Description of Artificial Sequence: Synthetic peptide
TGIA

SEQ ID NO: 6329 - protein, 4 aa, Artificial Sequence
  Description of Artificial Sequence: Synthetic peptide
MGSA

SEQ ID NO: 6330 - protein, 4 aa, Artificial Sequence
  Description of Artificial Sequence: Synthetic peptide
KGVA

SEQ ID NO: 6331 - protein, 4 aa, Artificial Sequence
  Description of Artificial Sequence: Synthetic peptide
TGVA

SEQ ID NO: 6332 - protein, 4 aa, Artificial Sequence
  Description of Artificial Sequence: Synthetic peptide
VGVA

SEQ ID NO: 6333 - protein, 4 aa, Artificial Sequence
  Description of Artificial Sequence: Synthetic peptide
PFGE

SEQ ID NO: 6334 - protein, 4 aa, Artificial Sequence
  Description of Artificial Sequence: Synthetic peptide
VVGE

SEQ ID NO: 6335 - protein, 4 aa, Artificial Sequence
  Description of Artificial Sequence: Synthetic peptide
ALGE

SEQ ID NO: 6336 - protein, 4 aa, Artificial Sequence
  Description of Artificial Sequence: Synthetic peptide
IFGE

SEQ ID NO: 6337 - protein, 4 aa, Artificial Sequence
  Description of Artificial Sequence: Synthetic peptide
PLGE

SEQ ID NO: 6338 - protein, 4 aa, Artificial Sequence
  Description of Artificial Sequence: Synthetic peptide
ILGE

SEQ ID NO: 6339 - protein, 4 aa, Artificial Sequence
  Description of Artificial Sequence: Synthetic peptide
PVGE

SEQ ID NO: 6340 - protein, 4 aa, Artificial Sequence
  Description of Artificial Sequence: Synthetic peptide
RVGE

SEQ ID NO: 6341 - protein, 4 aa, Artificial Sequence
  Description of Artificial Sequence: Synthetic peptide
LLGE

SEQ ID NO: 6342 - protein, 4 aa, Artificial Sequence
  Description of Artificial Sequence: Synthetic peptide
SVGE

SEQ ID NO: 6343 - protein, 4 aa, Artificial Sequence
  Description of Artificial Sequence: Synthetic peptide
GLGE

SEQ ID NO: 6344 - protein, 4 aa, Artificial Sequence
  Description of Artificial Sequence: Synthetic peptide
IVGE

SEQ ID NO: 6345 - protein, 4 aa, Artificial Sequence
  Description of Artificial Sequence: Synthetic peptide
LVGE

SEQ ID NO: 6346 - protein, 4 aa, Artificial Sequence
  Description of Artificial Sequence: Synthetic peptide
SLGE

SEQ ID NO: 6347 - protein, 4 aa, Artificial Sequence
  Description of Artificial Sequence: Synthetic peptide
TLGE

SEQ ID NO: 6348 - protein, 4 aa, Artificial Sequence
  Description of Artificial Sequence: Synthetic peptide
VLGE

SEQ ID NO: 6349 - protein, 4 aa, Artificial Sequence
  Description of Artificial Sequence: Synthetic peptide
TVGE

SEQ ID NO: 6350 - protein, 4 aa, Artificial Sequence
  Description of Artificial Sequence: Synthetic peptide
GVGE

SEQ ID NO: 6351 - protein, 4 aa, Artificial Sequence
  Description of Artificial Sequence: Synthetic peptide
AVGE

SEQ ID NO: 6352 - protein, 4 aa, Artificial Sequence
  Description of Artificial Sequence: Synthetic peptide
PYSY

SEQ ID NO: 6353 - protein, 4 aa, Artificial Sequence
  Description of Artificial Sequence: Synthetic peptide
PYSD

SEQ ID NO: 6354 - protein, 4 aa, Artificial Sequence
  Description of Artificial Sequence: Synthetic peptide
DYSD

SEQ ID NO: 6355 - protein, 4 aa, Artificial Sequence
  Description of Artificial Sequence: Synthetic peptide
DYSA

SEQ ID NO: 6356 - protein, 4 aa, Artificial Sequence
  Description of Artificial Sequence: Synthetic peptide
SYSD

SEQ ID NO: 6357 - protein, 4 aa, Artificial Sequence
  Description of Artificial Sequence: Synthetic peptide
FYSY

SEQ ID NO: 6358 - protein, 4 aa, Artificial Sequence
  Description of Artificial Sequence: Synthetic peptide
VYSY

SEQ ID NO: 6359 - protein, 4 aa, Artificial Sequence
  Description of Artificial Sequence: Synthetic peptide
FYSS

SEQ ID NO: 6360 - protein, 4 aa, Artificial Sequence
  Description of Artificial Sequence: Synthetic peptide
SYSS

SEQ ID NO: 6361 - protein, 4 aa, Artificial Sequence
  Description of Artificial Sequence: Synthetic peptide
YYSS

SEQ ID NO: 6362 - protein, 4 aa, Artificial Sequence
  Description of Artificial Sequence: Synthetic peptide
YYSY

SEQ ID NO: 6363 - protein, 4 aa, Artificial Sequence
  Description of Artificial Sequence: Synthetic peptide
AYSY

SEQ ID NO: 6364 - protein, 4 aa, Artificial Sequence
  Description of Artificial Sequence: Synthetic peptide
AYSD

SEQ ID NO: 6365 - protein, 4 aa, Artificial Sequence
  Description of Artificial Sequence: Synthetic peptide
HYSY

SEQ ID NO: 6366 - protein, 4 aa, Artificial Sequence
  Description of Artificial Sequence: Synthetic peptide
VYSD

SEQ ID NO: 6367 - protein, 4 aa, Artificial Sequence
  Description of Artificial Sequence: Synthetic peptide
FYSA

SEQ ID NO: 6368 - protein, 4 aa, Artificial Sequence
  Description of Artificial Sequence: Synthetic peptide
SYSY

SEQ ID NO: 6369 - protein, 4 aa, Artificial Sequence
  Description of Artificial Sequence: Synthetic peptide
SYSA

SEQ ID NO: 6370 - protein, 4 aa, Artificial Sequence
  Description of Artificial Sequence: Synthetic peptide
FYSD

SEQ ID NO: 6371 - protein, 4 aa, Artificial Sequence
  Description of Artificial Sequence: Synthetic peptide
YYSD

SEQ ID NO: 6372 - protein, 4 aa, Artificial Sequence
  Description of Artificial Sequence: Synthetic peptide
LYSY

SEQ ID NO: 6373 - protein, 4 aa, Artificial Sequence
  Description of Artificial Sequence: Synthetic peptide
YYSA

SEQ ID NO: 6374 - protein, 4 aa, Artificial Sequence
  Description of Artificial Sequence: Synthetic peptide
HYSS

SEQ ID NO: 6375 - protein, 4 aa, Artificial Sequence
  Description of Artificial Sequence: Synthetic peptide
DYSS

SEQ ID NO: 6376 - protein, 4 aa, Artificial Sequence
  Description of Artificial Sequence: Synthetic peptide
HYSA

SEQ ID NO: 6377 - protein, 4 aa, Artificial Sequence
  Description of Artificial Sequence: Synthetic peptide
DYSY

SEQ ID NO: 6378 - protein, 4 aa, Artificial Sequence
  Description of Artificial Sequence: Synthetic peptide
HYSD

SEQ ID NO: 6379 - protein, 4 aa, Artificial Sequence
  Description of Artificial Sequence: Synthetic peptide
LYSD

SEQ ID NO: 6380 - protein, 4 aa, Artificial Sequence
  Description of Artificial Sequence: Synthetic peptide
AVPA

SEQ ID NO: 6381 - protein, 4 aa, Artificial Sequence
  Description of Artificial Sequence: Synthetic peptide
AVRA

SEQ ID NO: 6382 - protein, 4 aa, Artificial Sequence
  Description of Artificial Sequence: Synthetic peptide
PVRA

SEQ ID NO: 6383 - protein, 4 aa, Artificial Sequence
  Description of Artificial Sequence: Synthetic peptide
PVPA

SEQ ID NO: 6384 - protein, 4 aa, Artificial Sequence
  Description of Artificial Sequence: Synthetic peptide
EVPA

SEQ ID NO: 6385 - protein, 4 aa, Artificial Sequence
  Description of Artificial Sequence: Synthetic peptide
LVGA

SEQ ID NO: 6386 - protein, 4 aa, Artificial Sequence
  Description of Artificial Sequence: Synthetic peptide
IVRA

SEQ ID NO: 6387 - protein, 4 aa, Artificial Sequence
  Description of Artificial Sequence: Synthetic peptide
QVGA

SEQ ID NO: 6388 - protein, 4 aa, Artificial Sequence
  Description of Artificial Sequence: Synthetic peptide
IVPA

SEQ ID NO: 6389 - protein, 4 aa, Artificial Sequence
  Description of Artificial Sequence: Synthetic peptide
EVGA

SEQ ID NO: 6390 - protein, 4 aa, Artificial Sequence
  Description of Artificial Sequence: Synthetic peptide
LVPA

SEQ ID NO: 6391 - protein, 4 aa, Artificial Sequence
  Description of Artificial Sequence: Synthetic peptide
QVPA

SEQ ID NO: 6392 - protein, 4 aa, Artificial Sequence
  Description of Artificial Sequence: Synthetic peptide
AVGA

SEQ ID NO: 6393 - protein, 4 aa, Artificial Sequence
  Description of Artificial Sequence: Synthetic peptide
QVRA

SEQ ID NO: 6394 - protein, 4 aa, Artificial Sequence
  Description of Artificial Sequence: Synthetic peptide
TVRA

SEQ ID NO: 6395 - protein, 4 aa, Artificial Sequence
  Description of Artificial Sequence: Synthetic peptide
KVGA

SEQ ID NO: 6396 - protein, 4 aa, Artificial Sequence
  Description of Artificial Sequence: Synthetic peptide
VVGA

SEQ ID NO: 6397 - protein, 4 aa, Artificial Sequence
  Description of Artificial Sequence: Synthetic peptide
EVRA

SEQ ID NO: 6398 - protein, 4 aa, Artificial Sequence
  Description of Artificial Sequence: Synthetic peptide
LVRA

SEQ ID NO: 6399 - protein, 4 aa, Artificial Sequence
  Description of Artificial Sequence: Synthetic peptide
VVRA

SEQ ID NO: 6400 - protein, 4 aa, Artificial Sequence
  Description of Artificial Sequence: Synthetic peptide
PVGA

SEQ ID NO: 6401 - protein, 4 aa, Artificial Sequence
  Description of Artificial Sequence: Synthetic peptide
TVGA

SEQ ID NO: 6402 - protein, 4 aa, Artificial Sequence
  Description of Artificial Sequence: Synthetic peptide
KVRA

SEQ ID NO: 6403 - protein, 4 aa, Artificial Sequence
  Description of Artificial Sequence: Synthetic peptide
KVPA

SEQ ID NO: 6404 - protein, 4 aa, Artificial Sequence
  Description of Artificial Sequence: Synthetic peptide
TVPA

SEQ ID NO: 6405 - protein, 4 aa, Artificial Sequence
  Description of Artificial Sequence: Synthetic peptide
GRGV

SEQ ID NO: 6406 - protein, 4 aa, Artificial Sequence
  Description of Artificial Sequence: Synthetic peptide
SRGV

SEQ ID NO: 6407 - protein, 4 aa, Artificial Sequence
  Description of Artificial Sequence: Synthetic peptide
ILGV

SEQ ID NO: 6408 - protein, 4 aa, Artificial Sequence
  Description of Artificial Sequence: Synthetic peptide
AQGV

SEQ ID NO: 6409 - protein, 4 aa, Artificial Sequence
  Description of Artificial Sequence: Synthetic peptide
TQGV

SEQ ID NO: 6410 - protein, 4 aa, Artificial Sequence
  Description of Artificial Sequence: Synthetic peptide
PQGV

SEQ ID NO: 6411 - protein, 4 aa, Artificial Sequence
  Description of Artificial Sequence: Synthetic peptide
SQGV

SEQ ID NO: 6412 - protein, 4 aa, Artificial Sequence
  Description of Artificial Sequence: Synthetic peptide
RRGV

SEQ ID NO: 6413 - protein, 4 aa, Artificial Sequence
  Description of Artificial Sequence: Synthetic peptide
PLGV

SEQ ID NO: 6414 - protein, 4 aa, Artificial Sequence
  Description of Artificial Sequence: Synthetic peptide
PRGV

SEQ ID NO: 6415 - protein, 4 aa, Artificial Sequence
  Description of Artificial Sequence: Synthetic peptide
IRGV

SEQ ID NO: 6416 - protein, 4 aa, Artificial Sequence
  Description of Artificial Sequence: Synthetic peptide
ALGV

SEQ ID NO: 6417 - protein, 4 aa, Artificial Sequence
  Description of Artificial Sequence: Synthetic peptide
TRGV

SEQ ID NO: 6418 - protein, 4 aa, Artificial Sequence
  Description of Artificial Sequence: Synthetic peptide
TLGV

SEQ ID NO: 6419 - protein, 4 aa, Artificial Sequence
  Description of Artificial Sequence: Synthetic peptide
GQGV

SEQ ID NO: 6420 - protein, 4 aa, Artificial Sequence
  Description of Artificial Sequence: Synthetic peptide
RQGV

SEQ ID NO: 6421 - protein, 4 aa, Artificial Sequence
  Description of Artificial Sequence: Synthetic peptide
RLGV

SEQ ID NO: 6422 - protein, 4 aa, Artificial Sequence
  Description of Artificial Sequence: Synthetic peptide
LRGV

SEQ ID NO: 6423 - protein, 4 aa, Artificial Sequence
  Description of Artificial Sequence: Synthetic peptide
SLGV

SEQ ID NO: 6424 - protein, 4 aa, Artificial Sequence
  Description of Artificial Sequence: Synthetic peptide
VLGV

SEQ ID NO: 6425 - protein, 4 aa, Artificial Sequence
  Description of Artificial Sequence: Synthetic peptide
IQGV

SEQ ID NO: 6426 - protein, 4 aa, Artificial Sequence
  Description of Artificial Sequence: Synthetic peptide
LLGV

SEQ ID NO: 6427 - protein, 4 aa, Artificial Sequence
  Description of Artificial Sequence: Synthetic peptide
LQGV

SEQ ID NO: 6428 - protein, 4 aa, Artificial Sequence
  Description of Artificial Sequence: Synthetic peptide
GLGV

SEQ ID NO: 6429 - protein, 4 aa, Artificial Sequence
  Description of Artificial Sequence: Synthetic peptide
DSSW

SEQ ID NO: 6430 - protein, 4 aa, Artificial Sequence
  Description of Artificial Sequence: Synthetic peptide
DSSR

SEQ ID NO: 6431 - protein, 4 aa, Artificial Sequence
  Description of Artificial Sequence: Synthetic peptide
DSSV

SEQ ID NO: 6432 - protein, 4 aa, Artificial Sequence
  Description of Artificial Sequence: Synthetic peptide
DSST

SEQ ID NO: 6433 - protein, 4 aa, Artificial Sequence
  Description of Artificial Sequence: Synthetic peptide
DSSM

SEQ ID NO: 6434 - protein, 4 aa, Artificial Sequence
  Description of Artificial Sequence: Synthetic peptide
DSSA

SEQ ID NO: 6435 - protein, 4 aa, Artificial Sequence
  Description of Artificial Sequence: Synthetic peptide
DSSS

SEQ ID NO: 6436 - protein, 4 aa, Artificial Sequence
  Description of Artificial Sequence: Synthetic peptide
DSSL

SEQ ID NO: 6437 - protein, 4 aa, Artificial Sequence
  Description of Artificial Sequence: Synthetic peptide
TGYS

SEQ ID NO: 6438 - protein, 4 aa, Artificial Sequence
  Description of Artificial Sequence: Synthetic peptide
SDYS

SEQ ID NO: 6439 - protein, 4 aa, Artificial Sequence
  Description of Artificial Sequence: Synthetic peptide
IAYS

SEQ ID NO: 6440 - protein, 4 aa, Artificial Sequence
  Description of Artificial Sequence: Synthetic peptide
VDYS

SEQ ID NO: 6441 - protein, 4 aa, Artificial Sequence
  Description of Artificial Sequence: Synthetic peptide
LDYS

SEQ ID NO: 6442 - protein, 4 aa, Artificial Sequence
  Description of Artificial Sequence: Synthetic peptide
PDYS

SEQ ID NO: 6443 - protein, 4 aa, Artificial Sequence
  Description of Artificial Sequence: Synthetic peptide
SAYS

SEQ ID NO: 6444 - protein, 4 aa, Artificial Sequence
  Description of Artificial Sequence: Synthetic peptide
TDYS

SEQ ID NO: 6445 - protein, 4 aa, Artificial Sequence
  Description of Artificial Sequence: Synthetic peptide
LAYS

SEQ ID NO: 6446 - protein, 4 aa, Artificial Sequence
  Description of Artificial Sequence: Synthetic peptide
GAYS

SEQ ID NO: 6447 - protein, 4 aa, Artificial Sequence
  Description of Artificial Sequence: Synthetic peptide
GDYS

SEQ ID NO: 6448 - protein, 4 aa, Artificial Sequence
  Description of Artificial Sequence: Synthetic peptide
VAYS

SEQ ID NO: 6449 - protein, 4 aa, Artificial Sequence
  Description of Artificial Sequence: Synthetic peptide
RDYS

SEQ ID NO: 6450 - protein, 4 aa, Artificial Sequence
  Description of Artificial Sequence: Synthetic peptide
IDYS

SEQ ID NO: 6451 - protein, 4 aa, Artificial Sequence
  Description of Artificial Sequence: Synthetic peptide
RAYS

SEQ ID NO: 6452 - protein, 4 aa, Artificial Sequence
  Description of Artificial Sequence: Synthetic peptide
PAYS

SEQ ID NO: 6453 - protein, 4 aa, Artificial Sequence
  Description of Artificial Sequence: Synthetic peptide
ADYS

SEQ ID NO: 6454 - protein, 4 aa, Artificial Sequence
  Description of Artificial Sequence: Synthetic peptide
TAYS

SEQ ID NO: 6455 - protein, 4 aa, Artificial Sequence
  Description of Artificial Sequence: Synthetic peptide
IGYS

SEQ ID NO: 6456 - protein, 4 aa, Artificial Sequence
  Description of Artificial Sequence: Synthetic peptide
GGYS

SEQ ID NO: 6457 - protein, 4 aa, Artificial Sequence
  Description of Artificial Sequence: Synthetic peptide
RGYS

SEQ ID NO: 6458 - protein, 4 aa, Artificial Sequence
  Description of Artificial Sequence: Synthetic peptide
AAYS

SEQ ID NO: 6459 - protein, 4 aa, Artificial Sequence
  Description of Artificial Sequence: Synthetic peptide
LYGS

SEQ ID NO: 6460 - protein, 4 aa, Artificial Sequence
  Description of Artificial Sequence: Synthetic peptide
TYGS

SEQ ID NO: 6461 - protein, 4 aa, Artificial Sequence
  Description of Artificial Sequence: Synthetic peptide
DYGS

SEQ ID NO: 6462 - protein, 4 aa, Artificial Sequence
  Description of Artificial Sequence: Synthetic peptide
SYGS

SEQ ID NO: 6463 - protein, 4 aa, Artificial Sequence
  Description of Artificial Sequence: Synthetic peptide
FYGS

SEQ ID NO: 6464 - protein, 4 aa, Artificial Sequence
  Description of Artificial Sequence: Synthetic peptide
NYGS

SEQ ID NO: 6465 - protein, 4 aa, Artificial Sequence
  Description of Artificial Sequence: Synthetic peptide
HYGS

SEQ ID NO: 6466 - protein, 4 aa, Artificial Sequence
  Description of Artificial Sequence: Synthetic peptide
VYGS

SEQ ID NO: 6467 - protein, 4 aa, Artificial Sequence
  Description of Artificial Sequence: Synthetic peptide
AYGS

SEQ ID NO: 6468 - protein, 4 aa, Artificial Sequence
  Description of Artificial Sequence: Synthetic peptide
PYGS

SEQ ID NO: 6469 - protein, 4 aa, Artificial Sequence
  Description of Artificial Sequence: Synthetic peptide
IYGS

SEQ ID NO: 6470 - protein, 4 aa, Artificial Sequence
  Description of Artificial Sequence: Synthetic peptide
YYYS

SEQ ID NO: 6471 - protein, 4 aa, Artificial Sequence
  Description of Artificial Sequence: Synthetic peptide
SYYS

SEQ ID NO: 6472 - protein, 4 aa, Artificial Sequence
  Description of Artificial Sequence: Synthetic peptide
YYYY

SEQ ID NO: 6473 - protein, 4 aa, Artificial Sequence
  Description of Artificial Sequence: Synthetic peptide
PYYF

SEQ ID NO: 6474 - protein, 4 aa, Artificial Sequence
  Description of Artificial Sequence: Synthetic peptide
FYYS

SEQ ID NO: 6475 - protein, 4 aa, Artificial Sequence
  Description of Artificial Sequence: Synthetic peptide
NYYS

SEQ ID NO: 6476 - protein, 4 aa, Artificial Sequence
  Description of Artificial Sequence: Synthetic peptide
NYYF

SEQ ID NO: 6477 - protein, 4 aa, Artificial Sequence
  Description of Artificial Sequence: Synthetic peptide
FYYF

SEQ ID NO: 6478 - protein, 4 aa, Artificial Sequence
  Description of Artificial Sequence: Synthetic peptide
FYYY

SEQ ID NO: 6479 - protein, 4 aa, Artificial Sequence
  Description of Artificial Sequence: Synthetic peptide
AYYY

SEQ ID NO: 6480 - protein, 4 aa, Artificial Sequence
  Description of Artificial Sequence: Synthetic peptide
SYYY

SEQ ID NO: 6481 - protein, 4 aa, Artificial Sequence
  Description of Artificial Sequence: Synthetic peptide
DYYY

SEQ ID NO: 6482 - protein, 4 aa, Artificial Sequence
  Description of Artificial Sequence: Synthetic peptide
AYYS

SEQ ID NO: 6483 - protein, 4 aa, Artificial Sequence
  Description of Artificial Sequence: Synthetic peptide
IYYY

SEQ ID NO: 6484 - protein, 4 aa, Artificial Sequence
  Description of Artificial Sequence: Synthetic peptide
LYYY

SEQ ID NO: 6485 - protein, 4 aa, Artificial Sequence
  Description of Artificial Sequence: Synthetic peptide
DYYS

SEQ ID NO: 6486 - protein, 4 aa, Artificial Sequence
  Description of Artificial Sequence: Synthetic peptide
AYYF

SEQ ID NO: 6487 - protein, 4 aa, Artificial Sequence
  Description of Artificial Sequence: Synthetic peptide
PYYS

SEQ ID NO: 6488 - protein, 4 aa, Artificial Sequence
  Description of Artificial Sequence: Synthetic peptide
IYYS

SEQ ID NO: 6489 - protein, 4 aa, Artificial Sequence
  Description of Artificial Sequence: Synthetic peptide
YYYF

SEQ ID NO: 6490 - protein, 4 aa, Artificial Sequence
  Description of Artificial Sequence: Synthetic peptide
HYYS

SEQ ID NO: 6491 - protein, 4 aa, Artificial Sequence
  Description of Artificial Sequence: Synthetic peptide
PYYY

SEQ ID NO: 6492 - protein, 4 aa, Artificial Sequence
  Description of Artificial Sequence: Synthetic peptide
HYYF

SEQ ID NO: 6493 - protein, 4 aa, Artificial Sequence
  Description of Artificial Sequence: Synthetic peptide
HYYY

SEQ ID NO: 6494 - protein, 4 aa, Artificial Sequence
  Description of Artificial Sequence: Synthetic peptide
LYYS

SEQ ID NO: 6495 - protein, 4 aa, Artificial Sequence
  Description of Artificial Sequence: Synthetic peptide
VYYF

SEQ ID NO: 6496 - protein, 4 aa, Artificial Sequence
  Description of Artificial Sequence: Synthetic peptide
SYYF

SEQ ID NO: 6497 - protein, 4 aa, Artificial Sequence
  Description of Artificial Sequence: Synthetic peptide
IYYF

SEQ ID NO: 6498 - protein, 4 aa, Artificial Sequence
  Description of Artificial Sequence: Synthetic peptide
LYYF

SEQ ID NO: 6499 - protein, 4 aa, Artificial Sequence
  Description of Artificial Sequence: Synthetic peptide
DYYF

SEQ ID NO: 6500 - protein, 4 aa, Artificial Sequence
  Description of Artificial Sequence: Synthetic peptide
TYYS

SEQ ID NO: 6501 - protein, 4 aa, Artificial Sequence
  Description of Artificial Sequence: Synthetic peptide
NYYY

SEQ ID NO: 6502 - protein, 4 aa, Artificial Sequence
  Description of Artificial Sequence: Synthetic peptide
TYYF

SEQ ID NO: 6503 - protein, 4 aa, Artificial Sequence
  Description of Artificial Sequence: Synthetic peptide
TYYY

SEQ ID NO: 6504 - protein, 4 aa, Artificial Sequence
  Description of Artificial Sequence: Synthetic peptide
VYYS

SEQ ID NO: 6505 - protein, 4 aa, Artificial Sequence
  Description of Artificial Sequence: Synthetic peptide
VYYY

SEQ ID NO: 6506 - protein, 4 aa, Artificial Sequence
  Description of Artificial Sequence: Synthetic peptide
FSYS

SEQ ID NO: 6507 - protein, 4 aa, Artificial Sequence
  Description of Artificial Sequence: Synthetic peptide
VRYS

SEQ ID NO: 6508 - protein, 4 aa, Artificial Sequence
  Description of Artificial Sequence: Synthetic peptide
YSYS

SEQ ID NO: 6509 - protein, 4 aa, Artificial Sequence
  Description of Artificial Sequence: Synthetic peptide
LRYS

SEQ ID NO: 6510 - protein, 4 aa, Artificial Sequence
  Description of Artificial Sequence: Synthetic peptide
ARYS

SEQ ID NO: 6511 - protein, 4 aa, Artificial Sequence
  Description of Artificial Sequence: Synthetic peptide
FRYS

SEQ ID NO: 6512 - protein, 4 aa, Artificial Sequence
  Description of Artificial Sequence: Synthetic peptide
SRYS

SEQ ID NO: 6513 - protein, 4 aa, Artificial Sequence
  Description of Artificial Sequence: Synthetic peptide
DSYS

SEQ ID NO: 6514 - protein, 4 aa, Artificial Sequence
  Description of Artificial Sequence: Synthetic peptide
LSYS

SEQ ID NO: 6515 - protein, 4 aa, Artificial Sequence
  Description of Artificial Sequence: Synthetic peptide
HRYS

SEQ ID NO: 6516 - protein, 4 aa, Artificial Sequence
  Description of Artificial Sequence: Synthetic peptide
PSYS

SEQ ID NO: 6517 - protein, 4 aa, Artificial Sequence
  Description of Artificial Sequence: Synthetic peptide
HSYS

SEQ ID NO: 6518 - protein, 4 aa, Artificial Sequence
  Description of Artificial Sequence: Synthetic peptide
ASYS

SEQ ID NO: 6519 - protein, 4 aa, Artificial Sequence
  Description of Artificial Sequence: Synthetic peptide
YRYS

SEQ ID NO: 6520 - protein, 4 aa, Artificial Sequence
  Description of Artificial Sequence: Synthetic peptide
SSYS

SEQ ID NO: 6521 - protein, 4 aa, Artificial Sequence
  Description of Artificial Sequence: Synthetic peptide
PRYS

SEQ ID NO: 6522 - protein, 4 aa, Artificial Sequence
  Description of Artificial Sequence: Synthetic peptide
VSYS

SEQ ID NO: 6523 - protein, 4 aa, Artificial Sequence
  Description of Artificial Sequence: Synthetic peptide
DRYS

SEQ ID NO: 6524 - protein, 4 aa, Artificial Sequence
  Description of Artificial Sequence: Synthetic peptide
TWFG

SEQ ID NO: 6525 - protein, 4 aa, Artificial Sequence
  Description of Artificial Sequence: Synthetic peptide
GWFG

SEQ ID NO: 6526 - protein, 4 aa, Artificial Sequence
  Description of Artificial Sequence: Synthetic peptide
RWFG

SEQ ID NO: 6527 - protein, 4 aa, Artificial Sequence
  Description of Artificial Sequence: Synthetic peptide
PWFG

SEQ ID NO: 6528 - protein, 4 aa, Artificial Sequence
  Description of Artificial Sequence: Synthetic peptide
VWFG

SEQ ID NO: 6529 - protein, 4 aa, Artificial Sequence
  Description of Artificial Sequence: Synthetic peptide
SWFG

SEQ ID NO: 6530 - protein, 4 aa, Artificial Sequence
  Description of Artificial Sequence: Synthetic peptide
AWFG

SEQ ID NO: 6531 - protein, 4 aa, Artificial Sequence
  Description of Artificial Sequence: Synthetic peptide
IWFG

SEQ ID NO: 6532 - protein, 4 aa, Artificial Sequence
  Description of Artificial Sequence: Synthetic peptide
RYYY

SEQ ID NO: 6533 - protein, 4 aa, Artificial Sequence
  Description of Artificial Sequence: Synthetic peptide
RYYS

SEQ ID NO: 6534 - protein, 4 aa, Artificial Sequence
  Description of Artificial Sequence: Synthetic peptide
RYYF

SEQ ID NO: 6535 - protein, 4 aa, Artificial Sequence
  Description of Artificial Sequence: Synthetic peptide
GYYF

SEQ ID NO: 6536 - protein, 4 aa, Artificial Sequence
  Description of Artificial Sequence: Synthetic peptide
GYYS

SEQ ID NO: 6537 - protein, 4 aa, Artificial Sequence
  Description of Artificial Sequence: Synthetic peptide
KFGG

SEQ ID NO: 6538 - protein, 4 aa, Artificial Sequence
  Description of Artificial Sequence: Synthetic peptide
ALGG

SEQ ID NO: 6539 - protein, 4 aa, Artificial Sequence
  Description of Artificial Sequence: Synthetic peptide
ILGG

SEQ ID NO: 6540 - protein, 4 aa, Artificial Sequence
  Description of Artificial Sequence: Synthetic peptide
EFGG

SEQ ID NO: 6541 - protein, 4 aa, Artificial Sequence
  Description of Artificial Sequence: Synthetic peptide
QFGG

SEQ ID NO: 6542 - protein, 4 aa, Artificial Sequence
  Description of Artificial Sequence: Synthetic peptide
PLGG

SEQ ID NO: 6543 - protein, 4 aa, Artificial Sequence
  Description of Artificial Sequence: Synthetic peptide
VLGG

SEQ ID NO: 6544 - protein, 4 aa, Artificial Sequence
  Description of Artificial Sequence: Synthetic peptide
IVGG

SEQ ID NO: 6545 - protein, 4 aa, Artificial Sequence
  Description of Artificial Sequence: Synthetic peptide
LLGG

SEQ ID NO: 6546 - protein, 4 aa, Artificial Sequence
  Description of Artificial Sequence: Synthetic peptide
QLGG

SEQ ID NO: 6547 - protein, 4 aa, Artificial Sequence
  Description of Artificial Sequence: Synthetic peptide
KLGG

SEQ ID NO: 6548 - protein, 4 aa, Artificial Sequence
  Description of Artificial Sequence: Synthetic peptide
IFGG

SEQ ID NO: 6549 - protein, 4 aa, Artificial Sequence
  Description of Artificial Sequence: Synthetic peptide
PFGG

SEQ ID NO: 6550 - protein, 4 aa, Artificial Sequence
  Description of Artificial Sequence: Synthetic peptide
TLGG

SEQ ID NO: 6551 - protein, 5 aa, Artificial Sequence
  Description of Artificial Sequence: Synthetic peptide
YMVRD

SEQ ID NO: 6552 - protein, 5 aa, Artificial Sequence
  Description of Artificial Sequence: Synthetic peptide
SMVRG

SEQ ID NO: 6553 - protein, 5 aa, Artificial Sequence
  Description of Artificial Sequence: Synthetic peptide
FMVRD

SEQ ID NO: 6554 - protein, 5 aa, Artificial Sequence
  Description of Artificial Sequence: Synthetic peptide
FMVRA

SEQ ID NO: 6555 - protein, 5 aa, Artificial Sequence
  Description of Artificial Sequence: Synthetic peptide
DMVRA

SEQ ID NO: 6556 - protein, 5 aa, Artificial Sequence
  Description of Artificial Sequence: Synthetic peptide
HMVRG

SEQ ID NO: 6557 - protein, 5 aa, Artificial Sequence
  Description of Artificial Sequence: Synthetic peptide
LMVRG

SEQ ID NO: 6558 - protein, 5 aa, Artificial Sequence
  Description of Artificial Sequence: Synthetic peptide
DMVRD

SEQ ID NO: 6559 - protein, 5 aa, Artificial Sequence
  Description of Artificial Sequence: Synthetic peptide
LMVRA

SEQ ID NO: 6560 - protein, 5 aa, Artificial Sequence
  Description of Artificial Sequence: Synthetic peptide
DMVRG

SEQ ID NO: 6561 - protein, 5 aa, Artificial Sequence
  Description of Artificial Sequence: Synthetic peptide
AMVRA

SEQ ID NO: 6562 - protein, 5 aa, Artificial Sequence
  Description of Artificial Sequence: Synthetic peptide
AMVRD

SEQ ID NO: 6563 - protein, 5 aa, Artificial Sequence
  Description of Artificial Sequence: Synthetic peptide
NMVRA

SEQ ID NO: 6564 - protein, 5 aa, Artificial Sequence
  Description of Artificial Sequence: Synthetic peptide
NMVRG

SEQ ID NO: 6565 - protein, 5 aa, Artificial Sequence
  Description of Artificial Sequence: Synthetic peptide
FMVRG

SEQ ID NO: 6566 - protein, 5 aa, Artificial Sequence
  Description of Artificial Sequence: Synthetic peptide
SMVRD

SEQ ID NO: 6567 - protein, 5 aa, Artificial Sequence
  Description of Artificial Sequence: Synthetic peptide
YMVRA

SEQ ID NO: 6568 - protein, 5 aa, Artificial Sequence
  Description of Artificial Sequence: Synthetic peptide
SMVRA

SEQ ID NO: 6569 - protein, 5 aa, Artificial Sequence
  Description of Artificial Sequence: Synthetic peptide
PMVRD

SEQ ID NO: 6570 - protein, 5 aa, Artificial Sequence
  Description of Artificial Sequence: Synthetic peptide
YMVRG

SEQ ID NO: 6571 - protein, 5 aa, Artificial Sequence
  Description of Artificial Sequence: Synthetic peptide
PMVRA

SEQ ID NO: 6572 - protein, 5 aa, Artificial Sequence
  Description of Artificial Sequence: Synthetic peptide
PMVRG

SEQ ID NO: 6573 - protein, 5 aa, Artificial Sequence
  Description of Artificial Sequence: Synthetic peptide
VMVRA

SEQ ID NO: 6574 - protein, 5 aa, Artificial Sequence
  Description of Artificial Sequence: Synthetic peptide
NMVRD

SEQ ID NO: 6575 - protein, 5 aa, Artificial Sequence
  Description of Artificial Sequence: Synthetic peptide
VMVRG

SEQ ID NO: 6576 - protein, 5 aa, Artificial Sequence
  Description of Artificial Sequence: Synthetic peptide
TMVRD

SEQ ID NO: 6577 - protein, 5 aa, Artificial Sequence
  Description of Artificial Sequence: Synthetic peptide
VMVRD

SEQ ID NO: 6578 - protein, 5 aa, Artificial Sequence
  Description of Artificial Sequence: Synthetic peptide
TMVRA

SEQ ID NO: 6579 - protein, 5 aa, Artificial Sequence
  Description of Artificial Sequence: Synthetic peptide
AMVRG

SEQ ID NO: 6580 - protein, 5 aa, Artificial Sequence
  Description of Artificial Sequence: Synthetic peptide
LMVRD

SEQ ID NO: 6581 - protein, 5 aa, Artificial Sequence
  Description of Artificial Sequence: Synthetic peptide
HMVRD

SEQ ID NO: 6582 - protein, 5 aa, Artificial Sequence
  Description of Artificial Sequence: Synthetic peptide
HMVRA

SEQ ID NO: 6583 - protein, 5 aa, Artificial Sequence
  Description of Artificial Sequence: Synthetic peptide
IMVRD

SEQ ID NO: 6584 - protein, 5 aa, Artificial Sequence
  Description of Artificial Sequence: Synthetic peptide
IMVRA

SEQ ID NO: 6585 - protein, 5 aa, Artificial Sequence
  Description of Artificial Sequence: Synthetic peptide
IMVRG

SEQ ID NO: 6586 - protein, 5 aa, Artificial Sequence
  Description of Artificial Sequence: Synthetic peptide
AYGDF

SEQ ID NO: 6587 - protein, 5 aa, Artificial Sequence
  Description of Artificial Sequence: Synthetic peptide
VYGDS

SEQ ID NO: 6588 - protein, 5 aa, Artificial Sequence
  Description of Artificial Sequence: Synthetic peptide
NYGDF

SEQ ID NO: 6589 - protein, 5 aa, Artificial Sequence
  Description of Artificial Sequence: Synthetic peptide
DYGDS

SEQ ID NO: 6590 - protein, 5 aa, Artificial Sequence
  Description of Artificial Sequence: Synthetic peptide
HYGDS

SEQ ID NO: 6591 - protein, 5 aa, Artificial Sequence
  Description of Artificial Sequence: Synthetic peptide
HYGDY

SEQ ID NO: 6592 - protein, 5 aa, Artificial Sequence
  Description of Artificial Sequence: Synthetic peptide
IYGDS

SEQ ID NO: 6593 - protein, 5 aa, Artificial Sequence
  Description of Artificial Sequence: Synthetic peptide
LYGDS

SEQ ID NO: 6594 - protein, 5 aa, Artificial Sequence
  Description of Artificial Sequence: Synthetic peptide
LYGDF

SEQ ID NO: 6595 - protein, 5 aa, Artificial Sequence
  Description of Artificial Sequence: Synthetic peptide
AYGDY

SEQ ID NO: 6596 - protein, 5 aa, Artificial Sequence
  Description of Artificial Sequence: Synthetic peptide
AYGDS

SEQ ID NO: 6597 - protein, 5 aa, Artificial Sequence
  Description of Artificial Sequence: Synthetic peptide
SYGDS

SEQ ID NO: 6598 - protein, 5 aa, Artificial Sequence
  Description of Artificial Sequence: Synthetic peptide
SYGDY

SEQ ID NO: 6599 - protein, 5 aa, Artificial Sequence
  Description of Artificial Sequence: Synthetic peptide
NYGDS

SEQ ID NO: 6600 - protein, 5 aa, Artificial Sequence
  Description of Artificial Sequence: Synthetic peptide
HYGDF

SEQ ID NO: 6601 - protein, 5 aa, Artificial Sequence
  Description of Artificial Sequence: Synthetic peptide
FYGDS

SEQ ID NO: 6602 - protein, 5 aa, Artificial Sequence
  Description of Artificial Sequence: Synthetic peptide
IYGDF

SEQ ID NO: 6603 - protein, 5 aa, Artificial Sequence
  Description of Artificial Sequence: Synthetic peptide
FYGDY

SEQ ID NO: 6604 - protein, 5 aa, Artificial Sequence
  Description of Artificial Sequence: Synthetic peptide
VYGDY

SEQ ID NO: 6605 - protein, 5 aa, Artificial Sequence
  Description of Artificial Sequence: Synthetic peptide
NYGDY

SEQ ID NO: 6606 - protein, 5 aa, Artificial Sequence
  Description of Artificial Sequence: Synthetic peptide
YYGDS

SEQ ID NO: 6607 - protein, 5 aa, Artificial Sequence
  Description of Artificial Sequence: Synthetic peptide
YYGDF

SEQ ID NO: 6608 - protein, 5 aa, Artificial Sequence
  Description of Artificial Sequence: Synthetic peptide
PYGDY

SEQ ID NO: 6609 - protein, 5 aa, Artificial Sequence
  Description of Artificial Sequence: Synthetic peptide
SYGDF

SEQ ID NO: 6610 - protein, 5 aa, Artificial Sequence
  Description of Artificial Sequence: Synthetic peptide
TYGDS

SEQ ID NO: 6611 - protein, 5 aa, Artificial Sequence
  Description of Artificial Sequence: Synthetic peptide
TYGDY

SEQ ID NO: 6612 - protein, 5 aa, Artificial Sequence
  Description of Artificial Sequence: Synthetic peptide
LYGDY

SEQ ID NO: 6613 - protein, 5 aa, Artificial Sequence
  Description of Artificial Sequence: Synthetic peptide
DYGDF

SEQ ID NO: 6614 - protein, 5 aa, Artificial Sequence
  Description of Artificial Sequence: Synthetic peptide
IYGDY

SEQ ID NO: 6615 - protein, 5 aa, Artificial Sequence
  Description of Artificial Sequence: Synthetic peptide
VYGDF

SEQ ID NO: 6616 - protein, 5 aa, Artificial Sequence
  Description of Artificial Sequence: Synthetic peptide
FYGDF

SEQ ID NO: 6617 - protein, 5 aa, Artificial Sequence
  Description of Artificial Sequence: Synthetic peptide
TYGDF

SEQ ID NO: 6618 - protein, 5 aa, Artificial Sequence
  Description of Artificial Sequence: Synthetic peptide
PYGDF

SEQ ID NO: 6619 - protein, 5 aa, Artificial Sequence
  Description of Artificial Sequence: Synthetic peptide
PYGDS

SEQ ID NO: 6620 - protein, 5 aa, Artificial Sequence
  Description of Artificial Sequence: Synthetic peptide
YYGDY

SEQ ID NO: 6621 - protein, 5 aa, Artificial Sequence
  Description of Artificial Sequence: Synthetic peptide
TYSYD

SEQ ID NO: 6622 - protein, 5 aa, Artificial Sequence
  Description of Artificial Sequence: Synthetic peptide
PYSYG

SEQ ID NO: 6623 - protein, 5 aa, Artificial Sequence
  Description of Artificial Sequence: Synthetic peptide
RYSYD

SEQ ID NO: 6624 - protein, 5 aa, Artificial Sequence
  Description of Artificial Sequence: Synthetic peptide
AYSYV

SEQ ID NO: 6625 - protein, 5 aa, Artificial Sequence
  Description of Artificial Sequence: Synthetic peptide
PYSYA

SEQ ID NO: 6626 - protein, 5 aa, Artificial Sequence
  Description of Artificial Sequence: Synthetic peptide
TYSYV

SEQ ID NO: 6627 - protein, 5 aa, Artificial Sequence
  Description of Artificial Sequence: Synthetic peptide
PYSYD

SEQ ID NO: 6628 - protein, 5 aa, Artificial Sequence
  Description of Artificial Sequence: Synthetic peptide
TYSYG

SEQ ID NO: 6629 - protein, 5 aa, Artificial Sequence
  Description of Artificial Sequence: Synthetic peptide
AYSYD

SEQ ID NO: 6630 - protein, 5 aa, Artificial Sequence
  Description of Artificial Sequence: Synthetic peptide
RYSYA

SEQ ID NO: 6631 - protein, 5 aa, Artificial Sequence
  Description of Artificial Sequence: Synthetic peptide
PYSYV

SEQ ID NO: 6632 - protein, 5 aa, Artificial Sequence
  Description of Artificial Sequence: Synthetic peptide
GYSYA

SEQ ID NO: 6633 - protein, 5 aa, Artificial Sequence
  Description of Artificial Sequence: Synthetic peptide
GYSYD

SEQ ID NO: 6634 - protein, 5 aa, Artificial Sequence
  Description of Artificial Sequence: Synthetic peptide
GYSYV

SEQ ID NO: 6635 - protein, 5 aa, Artificial Sequence
  Description of Artificial Sequence: Synthetic peptide
LYSYG

SEQ ID NO: 6636 - protein, 5 aa, Artificial Sequence
  Description of Artificial Sequence: Synthetic peptide
SYSYV

SEQ ID NO: 6637 - protein, 5 aa, Artificial Sequence
  Description of Artificial Sequence: Synthetic peptide
LYSYA

SEQ ID NO: 6638 - protein, 5 aa, Artificial Sequence
  Description of Artificial Sequence: Synthetic peptide
LYSYD

SEQ ID NO: 6639 - protein, 5 aa, Artificial Sequence
  Description of Artificial Sequence: Synthetic peptide
RYSYV

SEQ ID NO: 6640 - protein, 5 aa, Artificial Sequence
  Description of Artificial Sequence: Synthetic peptide
IYSYD

SEQ ID NO: 6641 - protein, 5 aa, Artificial Sequence
  Description of Artificial Sequence: Synthetic peptide
VYSYV

SEQ ID NO: 6642 - protein, 5 aa, Artificial Sequence
  Description of Artificial Sequence: Synthetic peptide
IYSYG

SEQ ID NO: 6643 - protein, 5 aa, Artificial Sequence
  Description of Artificial Sequence: Synthetic peptide
IYSYA

SEQ ID NO: 6644 - protein, 5 aa, Artificial Sequence
  Description of Artificial Sequence: Synthetic peptide
IYSYV

SEQ ID NO: 6645 - protein, 5 aa, Artificial Sequence
  Description of Artificial Sequence: Synthetic peptide
RYSYG

SEQ ID NO: 6646 - protein, 5 aa, Artificial Sequence
  Description of Artificial Sequence: Synthetic peptide
VYSYA

SEQ ID NO: 6647 - protein, 5 aa, Artificial Sequence
  Description of Artificial Sequence: Synthetic peptide
AYSYA

SEQ ID NO: 6648 - protein, 5 aa, Artificial Sequence
  Description of Artificial Sequence: Synthetic peptide
SYSYA

SEQ ID NO: 6649 - protein, 5 aa, Artificial Sequence
  Description of Artificial Sequence: Synthetic peptide
VYSYG

SEQ ID NO: 6650 - protein, 5 aa, Artificial Sequence
  Description of Artificial Sequence: Synthetic peptide
AYSYG

SEQ ID NO: 6651 - protein, 5 aa, Artificial Sequence
  Description of Artificial Sequence: Synthetic peptide
VYSYD

SEQ ID NO: 6652 - protein, 5 aa, Artificial Sequence
  Description of Artificial Sequence: Synthetic peptide
TYSYA

SEQ ID NO: 6653 - protein, 5 aa, Artificial Sequence
  Description of Artificial Sequence: Synthetic peptide
SYSYD

SEQ ID NO: 6654 - protein, 5 aa, Artificial Sequence
  Description of Artificial Sequence: Synthetic peptide
SYSYG

SEQ ID NO: 6655 - protein, 5 aa, Artificial Sequence
  Description of Artificial Sequence: Synthetic peptide
LYSYV

SEQ ID NO: 6656 - protein, 5 aa, Artificial Sequence
  Description of Artificial Sequence: Synthetic peptide
GSGSS

SEQ ID NO: 6657 - protein, 5 aa, Artificial Sequence
  Description of Artificial Sequence: Synthetic peptide
GSGSF

SEQ ID NO: 6658 - protein, 5 aa, Artificial Sequence
  Description of Artificial Sequence: Synthetic peptide
ASGSS

SEQ ID NO: 6659 - protein, 5 aa, Artificial Sequence
  Description of Artificial Sequence: Synthetic peptide
RSGSY

SEQ ID NO: 6660 - protein, 5 aa, Artificial Sequence
  Description of Artificial Sequence: Synthetic peptide
NSGSY

SEQ ID NO: 6661 - protein, 5 aa, Artificial Sequence
  Description of Artificial Sequence: Synthetic peptide
NSGSS

SEQ ID NO: 6662 - protein, 5 aa, Artificial Sequence
  Description of Artificial Sequence: Synthetic peptide
TSGSS

SEQ ID NO: 6663 - protein, 5 aa, Artificial Sequence
  Description of Artificial Sequence: Synthetic peptide
RSGSS

SEQ ID NO: 6664 - protein, 5 aa, Artificial Sequence
  Description of Artificial Sequence: Synthetic peptide
SSGSY

SEQ ID NO: 6665 - protein, 5 aa, Artificial Sequence
  Description of Artificial Sequence: Synthetic peptide
VSGSF

SEQ ID NO: 6666 - protein, 5 aa, Artificial Sequence
  Description of Artificial Sequence: Synthetic peptide
HSGSY

SEQ ID NO: 6667 - protein, 5 aa, Artificial Sequence
  Description of Artificial Sequence: Synthetic peptide
TSGSY

SEQ ID NO: 6668 - protein, 5 aa, Artificial Sequence
  Description of Artificial Sequence: Synthetic peptide
SSGSF

SEQ ID NO: 6669 - protein, 5 aa, Artificial Sequence
  Description of Artificial Sequence: Synthetic peptide
LSGSF

SEQ ID NO: 6670 - protein, 5 aa, Artificial Sequence
  Description of Artificial Sequence: Synthetic peptide
NSGSF

SEQ ID NO: 6671 - protein, 5 aa, Artificial Sequence
  Description of Artificial Sequence: Synthetic peptide
PSGSY

SEQ ID NO: 6672 - protein, 5 aa, Artificial Sequence
  Description of Artificial Sequence: Synthetic peptide
TSGSF

SEQ ID NO: 6673 - protein, 5 aa, Artificial Sequence
  Description of Artificial Sequence: Synthetic peptide
PSGSS

SEQ ID NO: 6674 - protein, 5 aa, Artificial Sequence
  Description of Artificial Sequence: Synthetic peptide
PSGSF

SEQ ID NO: 6675 - protein, 5 aa, Artificial Sequence
  Description of Artificial Sequence: Synthetic peptide
ISGSS

SEQ ID NO: 6676 - protein, 5 aa, Artificial Sequence
  Description of Artificial Sequence: Synthetic peptide
ISGSY

SEQ ID NO: 6677 - protein, 5 aa, Artificial Sequence
  Description of Artificial Sequence: Synthetic peptide
ASGSY

SEQ ID NO: 6678 - protein, 5 aa, Artificial Sequence
  Description of Artificial Sequence: Synthetic peptide
RSGSF

SEQ ID NO: 6679 - protein, 5 aa, Artificial Sequence
  Description of Artificial Sequence: Synthetic peptide
DSGSS

SEQ ID NO: 6680 - protein, 5 aa, Artificial Sequence
  Description of Artificial Sequence: Synthetic peptide
DSGSY

SEQ ID NO: 6681 - protein, 5 aa, Artificial Sequence
  Description of Artificial Sequence: Synthetic peptide
LSGSS

SEQ ID NO: 6682 - protein, 5 aa, Artificial Sequence
  Description of Artificial Sequence: Synthetic peptide
SSGSS

SEQ ID NO: 6683 - protein, 5 aa, Artificial Sequence
  Description of Artificial Sequence: Synthetic peptide
HSGSF

SEQ ID NO: 6684 - protein, 5 aa, Artificial Sequence
  Description of Artificial Sequence: Synthetic peptide
HSGSS

SEQ ID NO: 6685 - protein, 5 aa, Artificial Sequence
  Description of Artificial Sequence: Synthetic peptide
LSGSY

SEQ ID NO: 6686 - protein, 5 aa, Artificial Sequence
  Description of Artificial Sequence: Synthetic peptide
ASGSF

SEQ ID NO: 6687 - protein, 5 aa, Artificial Sequence
  Description of Artificial Sequence: Synthetic peptide
VSGSY

SEQ ID NO: 6688 - protein, 5 aa, Artificial Sequence
  Description of Artificial Sequence: Synthetic peptide
ISGSF

SEQ ID NO: 6689 - protein, 5 aa, Artificial Sequence
  Description of Artificial Sequence: Synthetic peptide
VSGSS

SEQ ID NO: 6690 - protein, 5 aa, Artificial Sequence
  Description of Artificial Sequence: Synthetic peptide
DSGSF

SEQ ID NO: 6691 - protein, 5 aa, Artificial Sequence
  Description of Artificial Sequence: Synthetic peptide
IFLES

SEQ ID NO: 6692 - protein, 5 aa, Artificial Sequence
  Description of Artificial Sequence: Synthetic peptide
IFLEL

SEQ ID NO: 6693 - protein, 5 aa, Artificial Sequence
  Description of Artificial Sequence: Synthetic peptide
RFLES

SEQ ID NO: 6694 - protein, 5 aa, Artificial Sequence
  Description of Artificial Sequence: Synthetic peptide
LFLEL

SEQ ID NO: 6695 - protein, 5 aa, Artificial Sequence
  Description of Artificial Sequence: Synthetic peptide
TFLES

SEQ ID NO: 6696 - protein, 5 aa, Artificial Sequence
  Description of Artificial Sequence: Synthetic peptide
GFLEW

SEQ ID NO: 6697 - protein, 5 aa, Artificial Sequence
  Description of Artificial Sequence: Synthetic peptide
GFLES

SEQ ID NO: 6698 - protein, 5 aa, Artificial Sequence
  Description of Artificial Sequence: Synthetic peptide
TFLEW

SEQ ID NO: 6699 - protein, 5 aa, Artificial Sequence
  Description of Artificial Sequence: Synthetic peptide
TFLEL

SEQ ID NO: 6700 - protein, 5 aa, Artificial Sequence
  Description of Artificial Sequence: Synthetic peptide
VFLEW

SEQ ID NO: 6701 - protein, 5 aa, Artificial Sequence
  Description of Artificial Sequence: Synthetic peptide
SFLEL

SEQ ID NO: 6702 - protein, 5 aa, Artificial Sequence
  Description of Artificial Sequence: Synthetic peptide
VFLES

SEQ ID NO: 6703 - protein, 5 aa, Artificial Sequence
  Description of Artificial Sequence: Synthetic peptide
GFLEL

SEQ ID NO: 6704 - protein, 5 aa, Artificial Sequence
  Description of Artificial Sequence: Synthetic peptide
VFLEL

SEQ ID NO: 6705 - protein, 5 aa, Artificial Sequence
  Description of Artificial Sequence: Synthetic peptide
AFLEL

SEQ ID NO: 6706 - protein, 5 aa, Artificial Sequence
  Description of Artificial Sequence: Synthetic peptide
PFLES

SEQ ID NO: 6707 - protein, 5 aa, Artificial Sequence
  Description of Artificial Sequence: Synthetic peptide
SFLEW

SEQ ID NO: 6708 - protein, 5 aa, Artificial Sequence
  Description of Artificial Sequence: Synthetic peptide
AFLES

SEQ ID NO: 6709 - protein, 5 aa, Artificial Sequence
  Description of Artificial Sequence: Synthetic peptide
AFLEW

SEQ ID NO: 6710 - protein, 5 aa, Artificial Sequence
  Description of Artificial Sequence: Synthetic peptide
LFLEW

SEQ ID NO: 6711 - protein, 5 aa, Artificial Sequence
  Description of Artificial Sequence: Synthetic peptide
PFLEL

SEQ ID NO: 6712 - protein, 5 aa, Artificial Sequence
  Description of Artificial Sequence: Synthetic peptide
RFLEL

SEQ ID NO: 6713 - protein, 5 aa, Artificial Sequence
  Description of Artificial Sequence: Synthetic peptide
LFLES

SEQ ID NO: 6714 - protein, 5 aa, Artificial Sequence
  Description of Artificial Sequence: Synthetic peptide
PFLEW

SEQ ID NO: 6715 - protein, 5 aa, Artificial Sequence
  Description of Artificial Sequence: Synthetic peptide
SFLES

SEQ ID NO: 6716 - protein, 5 aa, Artificial Sequence
  Description of Artificial Sequence: Synthetic peptide
IFLEW

SEQ ID NO: 6717 - protein, 5 aa, Artificial Sequence
  Description of Artificial Sequence: Synthetic peptide
PGSYS

SEQ ID NO: 6718 - protein, 5 aa, Artificial Sequence
  Description of Artificial Sequence: Synthetic peptide
AGSYA

SEQ ID NO: 6719 - protein, 5 aa, Artificial Sequence
  Description of Artificial Sequence: Synthetic peptide
HGSYS

SEQ ID NO: 6720 - protein, 5 aa, Artificial Sequence
  Description of Artificial Sequence: Synthetic peptide
HGSYY

SEQ ID NO: 6721 - protein, 5 aa, Artificial Sequence
  Description of Artificial Sequence: Synthetic peptide
PGSYY

SEQ ID NO: 6722 - protein, 5 aa, Artificial Sequence
  Description of Artificial Sequence: Synthetic peptide
SGSYS

SEQ ID NO: 6723 - protein, 5 aa, Artificial Sequence
  Description of Artificial Sequence: Synthetic peptide
SGSYD

SEQ ID NO: 6724 - protein, 5 aa, Artificial Sequence
  Description of Artificial Sequence: Synthetic peptide
SGSYA

SEQ ID NO: 6725 - protein, 5 aa, Artificial Sequence
  Description of Artificial Sequence: Synthetic peptide
LGSYS

SEQ ID NO: 6726 - protein, 5 aa, Artificial Sequence
  Description of Artificial Sequence: Synthetic peptide
VGSYS

SEQ ID NO: 6727 - protein, 5 aa, Artificial Sequence
  Description of Artificial Sequence: Synthetic peptide
DGSYY

SEQ ID NO: 6728 - protein, 5 aa, Artificial Sequence
  Description of Artificial Sequence: Synthetic peptide
FGSYS

SEQ ID NO: 6729 - protein, 5 aa, Artificial Sequence
  Description of Artificial Sequence: Synthetic peptide
FGSYY

SEQ ID NO: 6730 - protein, 5 aa, Artificial Sequence
  Description of Artificial Sequence: Synthetic peptide
HGSYD

SEQ ID NO: 6731 - protein, 5 aa, Artificial Sequence
  Description of Artificial Sequence: Synthetic peptide
LGSYA

SEQ ID NO: 6732 - protein, 5 aa, Artificial Sequence
  Description of Artificial Sequence: Synthetic peptide
HGSYA

SEQ ID NO: 6733 - protein, 5 aa, Artificial Sequence
  Description of Artificial Sequence: Synthetic peptide
LGSYD

SEQ ID NO: 6734 - protein, 5 aa, Artificial Sequence
  Description of Artificial Sequence: Synthetic peptide
DGSYS

SEQ ID NO: 6735 - protein, 5 aa, Artificial Sequence
  Description of Artificial Sequence: Synthetic peptide
VGSYD

SEQ ID NO: 6736 - protein, 5 aa, Artificial Sequence
  Description of Artificial Sequence: Synthetic peptide
VGSYY

SEQ ID NO: 6737 - protein, 5 aa, Artificial Sequence
  Description of Artificial Sequence: Synthetic peptide
AGSYY

SEQ ID NO: 6738 - protein, 5 aa, Artificial Sequence
  Description of Artificial Sequence: Synthetic peptide
YGSYS

SEQ ID NO: 6739 - protein, 5 aa, Artificial Sequence
  Description of Artificial Sequence: Synthetic peptide
AGSYS

SEQ ID NO: 6740 - protein, 5 aa, Artificial Sequence
  Description of Artificial Sequence: Synthetic peptide
AGSYD

SEQ ID NO: 6741 - protein, 5 aa, Artificial Sequence
  Description of Artificial Sequence: Synthetic peptide
VGSYA

SEQ ID NO: 6742 - protein, 5 aa, Artificial Sequence
  Description of Artificial Sequence: Synthetic peptide
DGSYD

SEQ ID NO: 6743 - protein, 5 aa, Artificial Sequence
  Description of Artificial Sequence: Synthetic peptide
FGSYD

SEQ ID NO: 6744 - protein, 5 aa, Artificial Sequence
  Description of Artificial Sequence: Synthetic peptide
DGSYA

SEQ ID NO: 6745 - protein, 5 aa, Artificial Sequence
  Description of Artificial Sequence: Synthetic peptide
YGSYA

SEQ ID NO: 6746 - protein, 5 aa, Artificial Sequence
  Description of Artificial Sequence: Synthetic peptide
FGSYA

SEQ ID NO: 6747 - protein, 5 aa, Artificial Sequence
  Description of Artificial Sequence: Synthetic peptide
YGSYD

SEQ ID NO: 6748 - protein, 5 aa, Artificial Sequence
  Description of Artificial Sequence: Synthetic peptide
LGSYY

SEQ ID NO: 6749 - protein, 5 aa, Artificial Sequence
  Description of Artificial Sequence: Synthetic peptide
PGSYA

SEQ ID NO: 6750 - protein, 5 aa, Artificial Sequence
  Description of Artificial Sequence: Synthetic peptide
PGSYD

SEQ ID NO: 6751 - protein, 5 aa, Artificial Sequence
  Description of Artificial Sequence: Synthetic peptide
YGSYY

SEQ ID NO: 6752 - protein, 5 aa, Artificial Sequence
  Description of Artificial Sequence: Synthetic peptide
FSGSF

SEQ ID NO: 6753 - protein, 5 aa, Artificial Sequence
  Description of Artificial Sequence: Synthetic peptide
FSGSY

SEQ ID NO: 6754 - protein, 5 aa, Artificial Sequence
  Description of Artificial Sequence: Synthetic peptide
YSGSF

SEQ ID NO: 6755 - protein, 5 aa, Artificial Sequence
  Description of Artificial Sequence: Synthetic peptide
YSGSS

SEQ ID NO: 6756 - protein, 5 aa, Artificial Sequence
  Description of Artificial Sequence: Synthetic peptide
FSGSS

SEQ ID NO: 6757 - protein, 5 aa, Artificial Sequence
  Description of Artificial Sequence: Synthetic peptide
ASSSW

SEQ ID NO: 6758 - protein, 5 aa, Artificial Sequence
  Description of Artificial Sequence: Synthetic peptide
VSSSS

SEQ ID NO: 6759 - protein, 5 aa, Artificial Sequence
  Description of Artificial Sequence: Synthetic peptide
YSSSL

SEQ ID NO: 6760 - protein, 5 aa, Artificial Sequence
  Description of Artificial Sequence: Synthetic peptide
VSSSW

SEQ ID NO: 6761 - protein, 5 aa, Artificial Sequence
  Description of Artificial Sequence: Synthetic peptide
ASSSL

SEQ ID NO: 6762 - protein, 5 aa, Artificial Sequence
  Description of Artificial Sequence: Synthetic peptide
HSSSL

SEQ ID NO: 6763 - protein, 5 aa, Artificial Sequence
  Description of Artificial Sequence: Synthetic peptide
PSSSL

SEQ ID NO: 6764 - protein, 5 aa, Artificial Sequence
  Description of Artificial Sequence: Synthetic peptide
ASSSS

SEQ ID NO: 6765 - protein, 5 aa, Artificial Sequence
  Description of Artificial Sequence: Synthetic peptide
HSSSW

SEQ ID NO: 6766 - protein, 5 aa, Artificial Sequence
  Description of Artificial Sequence: Synthetic peptide
VSSSL

SEQ ID NO: 6767 - protein, 5 aa, Artificial Sequence
  Description of Artificial Sequence: Synthetic peptide
FSSSL

SEQ ID NO: 6768 - protein, 5 aa, Artificial Sequence
  Description of Artificial Sequence: Synthetic peptide
HSSSS

SEQ ID NO: 6769 - protein, 5 aa, Artificial Sequence
  Description of Artificial Sequence: Synthetic peptide
FSSSW

SEQ ID NO: 6770 - protein, 5 aa, Artificial Sequence
  Description of Artificial Sequence: Synthetic peptide
SSSSS

SEQ ID NO: 6771 - protein, 5 aa, Artificial Sequence
  Description of Artificial Sequence: Synthetic peptide
DSSSS

SEQ ID NO: 6772 - protein, 5 aa, Artificial Sequence
  Description of Artificial Sequence: Synthetic peptide
SSSSL

SEQ ID NO: 6773 - protein, 5 aa, Artificial Sequence
  Description of Artificial Sequence: Synthetic peptide
FSSSS

SEQ ID NO: 6774 - protein, 5 aa, Artificial Sequence
  Description of Artificial Sequence: Synthetic peptide
LSSSW

SEQ ID NO: 6775 - protein, 5 aa, Artificial Sequence
  Description of Artificial Sequence: Synthetic peptide
DSSSL

SEQ ID NO: 6776 - protein, 5 aa, Artificial Sequence
  Description of Artificial Sequence: Synthetic peptide
LSSSS

SEQ ID NO: 6777 - protein, 5 aa, Artificial Sequence
  Description of Artificial Sequence: Synthetic peptide
LSSSL

SEQ ID NO: 6778 - protein, 5 aa, Artificial Sequence
  Description of Artificial Sequence: Synthetic peptide
SSSSW

SEQ ID NO: 6779 - protein, 5 aa, Artificial Sequence
  Description of Artificial Sequence: Synthetic peptide
DSSSW

SEQ ID NO: 6780 - protein, 5 aa, Artificial Sequence
  Description of Artificial Sequence: Synthetic peptide
PSSSW

SEQ ID NO: 6781 - protein, 5 aa, Artificial Sequence
  Description of Artificial Sequence: Synthetic peptide
PSSSS

SEQ ID NO: 6782 - protein, 5 aa, Artificial Sequence
  Description of Artificial Sequence: Synthetic peptide
HSSGW

SEQ ID NO: 6783 - protein, 5 aa, Artificial Sequence
  Description of Artificial Sequence: Synthetic peptide
FSSGL

SEQ ID NO: 6784 - protein, 5 aa, Artificial Sequence
  Description of Artificial Sequence: Synthetic peptide
SSSGW

SEQ ID NO: 6785 - protein, 5 aa, Artificial Sequence
  Description of Artificial Sequence: Synthetic peptide
SSSGS

SEQ ID NO: 6786 - protein, 5 aa, Artificial Sequence
  Description of Artificial Sequence: Synthetic peptide
DSSGL

SEQ ID NO: 6787 - protein, 5 aa, Artificial Sequence
  Description of Artificial Sequence: Synthetic peptide
HSSGS

SEQ ID NO: 6788 - protein, 5 aa, Artificial Sequence
  Description of Artificial Sequence: Synthetic peptide
FSSGW

SEQ ID NO: 6789 - protein, 5 aa, Artificial Sequence
  Description of Artificial Sequence: Synthetic peptide
ASSGW

SEQ ID NO: 6790 - protein, 5 aa, Artificial Sequence
  Description of Artificial Sequence: Synthetic peptide
DSSGW

SEQ ID NO: 6791 - protein, 5 aa, Artificial Sequence
  Description of Artificial Sequence: Synthetic peptide
DSSGS

SEQ ID NO: 6792 - protein, 5 aa, Artificial Sequence
  Description of Artificial Sequence: Synthetic peptide
ASSGL

SEQ ID NO: 6793 - protein, 5 aa, Artificial Sequence
  Description of Artificial Sequence: Synthetic peptide
LSSGL

SEQ ID NO: 6794 - protein, 5 aa, Artificial Sequence
  Description of Artificial Sequence: Synthetic peptide
FSSGS

SEQ ID NO: 6795 - protein, 5 aa, Artificial Sequence
  Description of Artificial Sequence: Synthetic peptide
ASSGS

SEQ ID NO: 6796 - protein, 5 aa, Artificial Sequence
  Description of Artificial Sequence: Synthetic peptide
PSSGS

SEQ ID NO: 6797 - protein, 5 aa, Artificial Sequence
  Description of Artificial Sequence: Synthetic peptide
LSSGW

SEQ ID NO: 6798 - protein, 5 aa, Artificial Sequence
  Description of Artificial Sequence: Synthetic peptide
LSSGS

SEQ ID NO: 6799 - protein, 5 aa, Artificial Sequence
  Description of Artificial Sequence: Synthetic peptide
YSSGL

SEQ ID NO: 6800 - protein, 5 aa, Artificial Sequence
  Description of Artificial Sequence: Synthetic peptide
VSSGS

SEQ ID NO: 6801 - protein, 5 aa, Artificial Sequence
  Description of Artificial Sequence: Synthetic peptide
PSSGW

SEQ ID NO: 6802 - protein, 5 aa, Artificial Sequence
  Description of Artificial Sequence: Synthetic peptide
PSSGL

SEQ ID NO: 6803 - protein, 5 aa, Artificial Sequence
  Description of Artificial Sequence: Synthetic peptide
VSSGL

SEQ ID NO: 6804 - protein, 5 aa, Artificial Sequence
  Description of Artificial Sequence: Synthetic peptide
VSSGW

SEQ ID NO: 6805 - protein, 5 aa, Artificial Sequence
  Description of Artificial Sequence: Synthetic peptide
SSSGL

SEQ ID NO: 6806 - protein, 5 aa, Artificial Sequence
  Description of Artificial Sequence: Synthetic peptide
HSSGL

SEQ ID NO: 6807 - protein, 5 aa, Artificial Sequence
  Description of Artificial Sequence: Synthetic peptide
YSSGS

SEQ ID NO: 6808 - protein, 5 aa, Artificial Sequence
  Description of Artificial Sequence: Synthetic peptide
VTVTT

SEQ ID NO: 6809 - protein, 5 aa, Artificial Sequence
  Description of Artificial Sequence: Synthetic peptide
RTVTT

SEQ ID NO: 6810 - protein, 5 aa, Artificial Sequence
  Description of Artificial Sequence: Synthetic peptide
LTVTK

SEQ ID NO: 6811 - protein, 5 aa, Artificial Sequence
  Description of Artificial Sequence: Synthetic peptide
ATVTK

SEQ ID NO: 6812 - protein, 5 aa, Artificial Sequence
  Description of Artificial Sequence: Synthetic peptide
GTVTT

SEQ ID NO: 6813 - protein, 5 aa, Artificial Sequence
  Description of Artificial Sequence: Synthetic peptide
VTVTK

SEQ ID NO: 6814 - protein, 5 aa, Artificial Sequence
  Description of Artificial Sequence: Synthetic peptide
LTVTR

SEQ ID NO: 6815 - protein, 5 aa, Artificial Sequence
  Description of Artificial Sequence: Synthetic peptide
ATVTT

SEQ ID NO: 6816 - protein, 5 aa, Artificial Sequence
  Description of Artificial Sequence: Synthetic peptide
RTVTR

SEQ ID NO: 6817 - protein, 5 aa, Artificial Sequence
  Description of Artificial Sequence: Synthetic peptide
VTVTR

SEQ ID NO: 6818 - protein, 5 aa, Artificial Sequence
  Description of Artificial Sequence: Synthetic peptide
TTVTK

SEQ ID NO: 6819 - protein, 5 aa, Artificial Sequence
  Description of Artificial Sequence: Synthetic peptide
GTVTR

SEQ ID NO: 6820 - protein, 5 aa, Artificial Sequence
  Description of Artificial Sequence: Synthetic peptide
TTVTI

SEQ ID NO: 6821 - protein, 5 aa, Artificial Sequence
  Description of Artificial Sequence: Synthetic peptide
RTVTK

SEQ ID NO: 6822 - protein, 5 aa, Artificial Sequence
  Description of Artificial Sequence: Synthetic peptide
LTVTT

SEQ ID NO: 6823 - protein, 5 aa, Artificial Sequence
  Description of Artificial Sequence: Synthetic peptide
VTVTI

SEQ ID NO: 6824 - protein, 5 aa, Artificial Sequence
  Description of Artificial Sequence: Synthetic peptide
GTVTK

SEQ ID NO: 6825 - protein, 5 aa, Artificial Sequence
  Description of Artificial Sequence: Synthetic peptide
TTVTR

SEQ ID NO: 6826 - protein, 5 aa, Artificial Sequence
  Description of Artificial Sequence: Synthetic peptide
GTVTI

SEQ ID NO: 6827 - protein, 5 aa, Artificial Sequence
  Description of Artificial Sequence: Synthetic peptide
PTVTI

SEQ ID NO: 6828 - protein, 5 aa, Artificial Sequence
  Description of Artificial Sequence: Synthetic peptide
STVTT

SEQ ID NO: 6829 - protein, 5 aa, Artificial Sequence
  Description of Artificial Sequence: Synthetic peptide
STVTI

SEQ ID NO: 6830 - protein, 5 aa, Artificial Sequence
  Description of Artificial Sequence: Synthetic peptide
ITVTI

SEQ ID NO: 6831 - protein, 5 aa, Artificial Sequence
  Description of Artificial Sequence: Synthetic peptide
STVTK

SEQ ID NO: 6832 - protein, 5 aa, Artificial Sequence
  Description of Artificial Sequence: Synthetic peptide
STVTR

SEQ ID NO: 6833 - protein, 5 aa, Artificial Sequence
  Description of Artificial Sequence: Synthetic peptide
ATVTI

SEQ ID NO: 6834 - protein, 5 aa, Artificial Sequence
  Description of Artificial Sequence: Synthetic peptide
ITVTT

SEQ ID NO: 6835 - protein, 5 aa, Artificial Sequence
  Description of Artificial Sequence: Synthetic peptide
ITVTR

SEQ ID NO: 6836 - protein, 5 aa, Artificial Sequence
  Description of Artificial Sequence: Synthetic peptide
LTVTI

SEQ ID NO: 6837 - protein, 5 aa, Artificial Sequence
  Description of Artificial Sequence: Synthetic peptide
PTVTR

SEQ ID NO: 6838 - protein, 5 aa, Artificial Sequence
  Description of Artificial Sequence: Synthetic peptide
ATVTR

SEQ ID NO: 6839 - protein, 5 aa, Artificial Sequence
  Description of Artificial Sequence: Synthetic peptide
PTVTK

SEQ ID NO: 6840 - protein, 5 aa, Artificial Sequence
  Description of Artificial Sequence: Synthetic peptide
RTVTI

SEQ ID NO: 6841 - protein, 5 aa, Artificial Sequence
  Description of Artificial Sequence: Synthetic peptide
ITVTK

SEQ ID NO: 6842 - protein, 5 aa, Artificial Sequence
  Description of Artificial Sequence: Synthetic peptide
PTVTT

SEQ ID NO: 6843 - protein, 5 aa, Artificial Sequence
  Description of Artificial Sequence: Synthetic peptide
ASSSF

SEQ ID NO: 6844 - protein, 5 aa, Artificial Sequence
  Description of Artificial Sequence: Synthetic peptide
ASSSY

SEQ ID NO: 6845 - protein, 5 aa, Artificial Sequence
  Description of Artificial Sequence: Synthetic peptide
PSSSF

SEQ ID NO: 6846 - protein, 5 aa, Artificial Sequence
  Description of Artificial Sequence: Synthetic peptide
HSSSF

SEQ ID NO: 6847 - protein, 5 aa, Artificial Sequence
  Description of Artificial Sequence: Synthetic peptide
VSSSY

SEQ ID NO: 6848 - protein, 5 aa, Artificial Sequence
  Description of Artificial Sequence: Synthetic peptide
YSSSF

SEQ ID NO: 6849 - protein, 5 aa, Artificial Sequence
  Description of Artificial Sequence: Synthetic peptide
FSSSF

SEQ ID NO: 6850 - protein, 5 aa, Artificial Sequence
  Description of Artificial Sequence: Synthetic peptide
HSSSY

SEQ ID NO: 6851 - protein, 5 aa, Artificial Sequence
  Description of Artificial Sequence: Synthetic peptide
VSSSF

SEQ ID NO: 6852 - protein, 5 aa, Artificial Sequence
  Description of Artificial Sequence: Synthetic peptide
SSSSY

SEQ ID NO: 6853 - protein, 5 aa, Artificial Sequence
  Description of Artificial Sequence: Synthetic peptide
SSSSF

SEQ ID NO: 6854 - protein, 5 aa, Artificial Sequence
  Description of Artificial Sequence: Synthetic peptide
LSSSY

SEQ ID NO: 6855 - protein, 5 aa, Artificial Sequence
  Description of Artificial Sequence: Synthetic peptide
DSSSY

SEQ ID NO: 6856 - protein, 5 aa, Artificial Sequence
  Description of Artificial Sequence: Synthetic peptide
FSSSY

SEQ ID NO: 6857 - protein, 5 aa, Artificial Sequence
  Description of Artificial Sequence: Synthetic peptide
PSSSY

SEQ ID NO: 6858 - protein, 5 aa, Artificial Sequence
  Description of Artificial Sequence: Synthetic peptide
YSSSY

SEQ ID NO: 6859 - protein, 5 aa, Artificial Sequence
  Description of Artificial Sequence: Synthetic peptide
DSSSF

SEQ ID NO: 6860 - protein, 5 aa, Artificial Sequence
  Description of Artificial Sequence: Synthetic peptide
LSSSF

SEQ ID NO: 6861 - protein, 5 aa, Artificial Sequence
  Description of Artificial Sequence: Synthetic peptide
FSGWF

SEQ ID NO: 6862 - protein, 5 aa, Artificial Sequence
  Description of Artificial Sequence: Synthetic peptide
FSGWS

SEQ ID NO: 6863 - protein, 5 aa, Artificial Sequence
  Description of Artificial Sequence: Synthetic peptide
ISGWY

SEQ ID NO: 6864 - protein, 5 aa, Artificial Sequence
  Description of Artificial Sequence: Synthetic peptide
FSGWY

SEQ ID NO: 6865 - protein, 5 aa, Artificial Sequence
  Description of Artificial Sequence: Synthetic peptide
ISGWS

SEQ ID NO: 6866 - protein, 5 aa, Artificial Sequence
  Description of Artificial Sequence: Synthetic peptide
PSGWS

SEQ ID NO: 6867 - protein, 5 aa, Artificial Sequence
  Description of Artificial Sequence: Synthetic peptide
DSGWF

SEQ ID NO: 6868 - protein, 5 aa, Artificial Sequence
  Description of Artificial Sequence: Synthetic peptide
PSGWY

SEQ ID NO: 6869 - protein, 5 aa, Artificial Sequence
  Description of Artificial Sequence: Synthetic peptide
PSGWF

SEQ ID NO: 6870 - protein, 5 aa, Artificial Sequence
  Description of Artificial Sequence: Synthetic peptide
TSGWY

SEQ ID NO: 6871 - protein, 5 aa, Artificial Sequence
  Description of Artificial Sequence: Synthetic peptide
ASGWF

SEQ ID NO: 6872 - protein, 5 aa, Artificial Sequence
  Description of Artificial Sequence: Synthetic peptide
LSGWF

SEQ ID NO: 6873 - protein, 5 aa, Artificial Sequence
  Description of Artificial Sequence: Synthetic peptide
ISGWF

SEQ ID NO: 6874 - protein, 5 aa, Artificial Sequence
  Description of Artificial Sequence: Synthetic peptide
SSGWS

SEQ ID NO: 6875 - protein, 5 aa, Artificial Sequence
  Description of Artificial Sequence: Synthetic peptide
SSGWF

SEQ ID NO: 6876 - protein, 5 aa, Artificial Sequence
  Description of Artificial Sequence: Synthetic peptide
NSGWS

SEQ ID NO: 6877 - protein, 5 aa, Artificial Sequence
  Description of Artificial Sequence: Synthetic peptide
NSGWY

SEQ ID NO: 6878 - protein, 5 aa, Artificial Sequence
  Description of Artificial Sequence: Synthetic peptide
NSGWF

SEQ ID NO: 6879 - protein, 5 aa, Artificial Sequence
  Description of Artificial Sequence: Synthetic peptide
VSGWS

SEQ ID NO: 6880 - protein, 5 aa, Artificial Sequence
  Description of Artificial Sequence: Synthetic peptide
VSGWY

SEQ ID NO: 6881 - protein, 5 aa, Artificial Sequence
  Description of Artificial Sequence: Synthetic peptide
YSGWF

SEQ ID NO: 6882 - protein, 5 aa, Artificial Sequence
  Description of Artificial Sequence: Synthetic peptide
LSGWS

SEQ ID NO: 6883 - protein, 5 aa, Artificial Sequence
  Description of Artificial Sequence: Synthetic peptide
ASGWY

SEQ ID NO: 6884 - protein, 5 aa, Artificial Sequence
  Description of Artificial Sequence: Synthetic peptide
LSGWY

SEQ ID NO: 6885 - protein, 5 aa, Artificial Sequence
  Description of Artificial Sequence: Synthetic peptide
TSGWF

SEQ ID NO: 6886 - protein, 5 aa, Artificial Sequence
  Description of Artificial Sequence: Synthetic peptide
TSGWS

SEQ ID NO: 6887 - protein, 5 aa, Artificial Sequence
  Description of Artificial Sequence: Synthetic peptide
DSGWY

SEQ ID NO: 6888 - protein, 5 aa, Artificial Sequence
  Description of Artificial Sequence: Synthetic peptide
DSGWS

SEQ ID NO: 6889 - protein, 5 aa, Artificial Sequence
  Description of Artificial Sequence: Synthetic peptide
ASGWS

SEQ ID NO: 6890 - protein, 5 aa, Artificial Sequence
  Description of Artificial Sequence: Synthetic peptide
HSGWF

SEQ ID NO: 6891 - protein, 5 aa, Artificial Sequence
  Description of Artificial Sequence: Synthetic peptide
HSGWS

SEQ ID NO: 6892 - protein, 5 aa, Artificial Sequence
  Description of Artificial Sequence: Synthetic peptide
YSGWS

SEQ ID NO: 6893 - protein, 5 aa, Artificial Sequence
  Description of Artificial Sequence: Synthetic peptide
HSGWY

SEQ ID NO: 6894 - protein, 5 aa, Artificial Sequence
  Description of Artificial Sequence: Synthetic peptide
YSGWY

SEQ ID NO: 6895 - protein, 5 aa, Artificial Sequence
  Description of Artificial Sequence: Synthetic peptide
VSGWF

SEQ ID NO: 6896 - protein, 5 aa, Artificial Sequence
  Description of Artificial Sequence: Synthetic peptide
ISGYD

SEQ ID NO: 6897 - protein, 5 aa, Artificial Sequence
  Description of Artificial Sequence: Synthetic peptide
HSGYA

SEQ ID NO: 6898 - protein, 5 aa, Artificial Sequence
  Description of Artificial Sequence: Synthetic peptide
ISGYA

SEQ ID NO: 6899 - protein, 5 aa, Artificial Sequence
  Description of Artificial Sequence: Synthetic peptide
HSGYG

SEQ ID NO: 6900 - protein, 5 aa, Artificial Sequence
  Description of Artificial Sequence: Synthetic peptide
TSGYD

SEQ ID NO: 6901 - protein, 5 aa, Artificial Sequence
  Description of Artificial Sequence: Synthetic peptide
TSGYA

SEQ ID NO: 6902 - protein, 5 aa, Artificial Sequence
  Description of Artificial Sequence: Synthetic peptide
DSGYA

SEQ ID NO: 6903 - protein, 5 aa, Artificial Sequence
  Description of Artificial Sequence: Synthetic peptide
LSGYA

SEQ ID NO: 6904 - protein, 5 aa, Artificial Sequence
  Description of Artificial Sequence: Synthetic peptide
FSGYA

SEQ ID NO: 6905 - protein, 5 aa, Artificial Sequence
  Description of Artificial Sequence: Synthetic peptide
LSGYD

SEQ ID NO: 6906 - protein, 5 aa, Artificial Sequence
  Description of Artificial Sequence: Synthetic peptide
FSGYG

SEQ ID NO: 6907 - protein, 5 aa, Artificial Sequence
  Description of Artificial Sequence: Synthetic peptide
SSGYD

SEQ ID NO: 6908 - protein, 5 aa, Artificial Sequence
  Description of Artificial Sequence: Synthetic peptide
SSGYA

SEQ ID NO: 6909 - protein, 5 aa, Artificial Sequence
  Description of Artificial Sequence: Synthetic peptide
ISGYG

SEQ ID NO: 6910 - protein, 5 aa, Artificial Sequence
  Description of Artificial Sequence: Synthetic peptide
HSGYD

SEQ ID NO: 6911 - protein, 5 aa, Artificial Sequence
  Description of Artificial Sequence: Synthetic peptide
ASGYD

SEQ ID NO: 6912 - protein, 5 aa, Artificial Sequence
  Description of Artificial Sequence: Synthetic peptide
YSGYA

SEQ ID NO: 6913 - protein, 5 aa, Artificial Sequence
  Description of Artificial Sequence: Synthetic peptide
VSGYA

SEQ ID NO: 6914 - protein, 5 aa, Artificial Sequence
  Description of Artificial Sequence: Synthetic peptide
VSGYG

SEQ ID NO: 6915 - protein, 5 aa, Artificial Sequence
  Description of Artificial Sequence: Synthetic peptide
SSGYG

SEQ ID NO: 6916 - protein, 5 aa, Artificial Sequence
  Description of Artificial Sequence: Synthetic peptide
DSGYD

SEQ ID NO: 6917 - protein, 5 aa, Artificial Sequence
  Description of Artificial Sequence: Synthetic peptide
DSGYG

SEQ ID NO: 6918 - protein, 5 aa, Artificial Sequence
  Description of Artificial Sequence: Synthetic peptide
FSGYD

SEQ ID NO: 6919 - protein, 5 aa, Artificial Sequence
  Description of Artificial Sequence: Synthetic peptide
LSGYG

SEQ ID NO: 6920 - protein, 5 aa, Artificial Sequence
  Description of Artificial Sequence: Synthetic peptide
TSGYG

SEQ ID NO: 6921 - protein, 5 aa, Artificial Sequence
  Description of Artificial Sequence: Synthetic peptide
NSGYA

SEQ ID NO: 6922 - protein, 5 aa, Artificial Sequence
  Description of Artificial Sequence: Synthetic peptide
NSGYG

SEQ ID NO: 6923 - protein, 5 aa, Artificial Sequence
  Description of Artificial Sequence: Synthetic peptide
NSGYD

SEQ ID NO: 6924 - protein, 5 aa, Artificial Sequence
  Description of Artificial Sequence: Synthetic peptide
PSGYA

SEQ ID NO: 6925 - protein, 5 aa, Artificial Sequence
  Description of Artificial Sequence: Synthetic peptide
PSGYG

SEQ ID NO: 6926 - protein, 5 aa, Artificial Sequence
  Description of Artificial Sequence: Synthetic peptide
PSGYD

SEQ ID NO: 6927 - protein, 5 aa, Artificial Sequence
  Description of Artificial Sequence: Synthetic peptide
ASGYG

SEQ ID NO: 6928 - protein, 5 aa, Artificial Sequence
  Description of Artificial Sequence: Synthetic peptide
VSGYD

SEQ ID NO: 6929 - protein, 5 aa, Artificial Sequence
  Description of Artificial Sequence: Synthetic peptide
ASGYA

SEQ ID NO: 6930 - protein, 5 aa, Artificial Sequence
  Description of Artificial Sequence: Synthetic peptide
YSGYG

SEQ ID NO: 6931 - protein, 5 aa, Artificial Sequence
  Description of Artificial Sequence: Synthetic peptide
FYYDS

SEQ ID NO: 6932 - protein, 5 aa, Artificial Sequence
  Description of Artificial Sequence: Synthetic peptide
YYYDT

SEQ ID NO: 6933 - protein, 5 aa, Artificial Sequence
  Description of Artificial Sequence: Synthetic peptide
DYYDS

SEQ ID NO: 6934 - protein, 5 aa, Artificial Sequence
  Description of Artificial Sequence: Synthetic peptide
AYYDS

SEQ ID NO: 6935 - protein, 5 aa, Artificial Sequence
  Description of Artificial Sequence: Synthetic peptide
AYYDT

SEQ ID NO: 6936 - protein, 5 aa, Artificial Sequence
  Description of Artificial Sequence: Synthetic peptide
DYYDI

SEQ ID NO: 6937 - protein, 5 aa, Artificial Sequence
  Description of Artificial Sequence: Synthetic peptide
VYYDI

SEQ ID NO: 6938 - protein, 5 aa, Artificial Sequence
  Description of Artificial Sequence: Synthetic peptide
FYYDT

SEQ ID NO: 6939 - protein, 5 aa, Artificial Sequence
  Description of Artificial Sequence: Synthetic peptide
LYYDI

SEQ ID NO: 6940 - protein, 5 aa, Artificial Sequence
  Description of Artificial Sequence: Synthetic peptide
PYYDI

SEQ ID NO: 6941 - protein, 5 aa, Artificial Sequence
  Description of Artificial Sequence: Synthetic peptide
HYYDI

SEQ ID NO: 6942 - protein, 5 aa, Artificial Sequence
  Description of Artificial Sequence: Synthetic peptide
IYYDI

SEQ ID NO: 6943 - protein, 5 aa, Artificial Sequence
  Description of Artificial Sequence: Synthetic peptide
LYYDS

SEQ ID NO: 6944 - protein, 5 aa, Artificial Sequence
  Description of Artificial Sequence: Synthetic peptide
SYYDI

SEQ ID NO: 6945 - protein, 5 aa, Artificial Sequence
  Description of Artificial Sequence: Synthetic peptide
NYYDT

SEQ ID NO: 6946 - protein, 5 aa, Artificial Sequence
  Description of Artificial Sequence: Synthetic peptide
NYYDS

SEQ ID NO: 6947 - protein, 5 aa, Artificial Sequence
  Description of Artificial Sequence: Synthetic peptide
SYYDT

SEQ ID NO: 6948 - protein, 5 aa, Artificial Sequence
  Description of Artificial Sequence: Synthetic peptide
AYYDI

SEQ ID NO: 6949 - protein, 5 aa, Artificial Sequence
  Description of Artificial Sequence: Synthetic peptide
SYYDS

SEQ ID NO: 6950 - protein, 5 aa, Artificial Sequence
  Description of Artificial Sequence: Synthetic peptide
DYYDT

SEQ ID NO: 6951 - protein, 5 aa, Artificial Sequence
  Description of Artificial Sequence: Synthetic peptide
VYYDT

SEQ ID NO: 6952 - protein, 5 aa, Artificial Sequence
  Description of Artificial Sequence: Synthetic peptide
YYYDI

SEQ ID NO: 6953 - protein, 5 aa, Artificial Sequence
  Description of Artificial Sequence: Synthetic peptide
VYYDS

SEQ ID NO: 6954 - protein, 5 aa, Artificial Sequence
  Description of Artificial Sequence: Synthetic peptide
FYYDI

SEQ ID NO: 6955 - protein, 5 aa, Artificial Sequence
  Description of Artificial Sequence: Synthetic peptide
TYYDT

SEQ ID NO: 6956 - protein, 5 aa, Artificial Sequence
  Description of Artificial Sequence: Synthetic peptide
NYYDI

SEQ ID NO: 6957 - protein, 5 aa, Artificial Sequence
  Description of Artificial Sequence: Synthetic peptide
HYYDS

SEQ ID NO: 6958 - protein, 5 aa, Artificial Sequence
  Description of Artificial Sequence: Synthetic peptide
LYYDT

SEQ ID NO: 6959 - protein, 5 aa, Artificial Sequence
  Description of Artificial Sequence: Synthetic peptide
IYYDT

SEQ ID NO: 6960 - protein, 5 aa, Artificial Sequence
  Description of Artificial Sequence: Synthetic peptide
IYYDS

SEQ ID NO: 6961 - protein, 5 aa, Artificial Sequence
  Description of Artificial Sequence: Synthetic peptide
PYYDT

SEQ ID NO: 6962 - protein, 5 aa, Artificial Sequence
  Description of Artificial Sequence: Synthetic peptide
PYYDS

SEQ ID NO: 6963 - protein, 5 aa, Artificial Sequence
  Description of Artificial Sequence: Synthetic peptide
TYYDI

SEQ ID NO: 6964 - protein, 5 aa, Artificial Sequence
  Description of Artificial Sequence: Synthetic peptide
HYYDT

SEQ ID NO: 6965 - protein, 5 aa, Artificial Sequence
  Description of Artificial Sequence: Synthetic peptide
TYYDS

SEQ ID NO: 6966 - protein, 5 aa, Artificial Sequence
  Description of Artificial Sequence: Synthetic peptide
SSSGY

SEQ ID NO: 6967 - protein, 5 aa, Artificial Sequence
  Description of Artificial Sequence: Synthetic peptide
DSSGF

SEQ ID NO: 6968 - protein, 5 aa, Artificial Sequence
  Description of Artificial Sequence: Synthetic peptide
HSSGY

SEQ ID NO: 6969 - protein, 5 aa, Artificial Sequence
  Description of Artificial Sequence: Synthetic peptide
SSSGF

SEQ ID NO: 6970 - protein, 5 aa, Artificial Sequence
  Description of Artificial Sequence: Synthetic peptide
ASSGF

SEQ ID NO: 6971 - protein, 5 aa, Artificial Sequence
  Description of Artificial Sequence: Synthetic peptide
ASSGY

SEQ ID NO: 6972 - protein, 5 aa, Artificial Sequence
  Description of Artificial Sequence: Synthetic peptide
LSSGF

SEQ ID NO: 6973 - protein, 5 aa, Artificial Sequence
  Description of Artificial Sequence: Synthetic peptide
FSSGY

SEQ ID NO: 6974 - protein, 5 aa, Artificial Sequence
  Description of Artificial Sequence: Synthetic peptide
FSSGF

SEQ ID NO: 6975 - protein, 5 aa, Artificial Sequence
  Description of Artificial Sequence: Synthetic peptide
YSSGF

SEQ ID NO: 6976 - protein, 5 aa, Artificial Sequence
  Description of Artificial Sequence: Synthetic peptide
PSSGY

SEQ ID NO: 6977 - protein, 5 aa, Artificial Sequence
  Description of Artificial Sequence: Synthetic peptide
VSSGY

SEQ ID NO: 6978 - protein, 5 aa, Artificial Sequence
  Description of Artificial Sequence: Synthetic peptide
LSSGY

SEQ ID NO: 6979 - protein, 5 aa, Artificial Sequence
  Description of Artificial Sequence: Synthetic peptide
HSSGF

SEQ ID NO: 6980 - protein, 5 aa, Artificial Sequence
  Description of Artificial Sequence: Synthetic peptide
PSSGF

SEQ ID NO: 6981 - protein, 5 aa, Artificial Sequence
  Description of Artificial Sequence: Synthetic peptide
VSSGF

SEQ ID NO: 6982 - protein, 5 aa, Artificial Sequence
  Description of Artificial Sequence: Synthetic peptide
YSSGY

SEQ ID NO: 6983 - protein, 5 aa, Artificial Sequence
  Description of Artificial Sequence: Synthetic peptide
QAARH

SEQ ID NO: 6984 - protein, 5 aa, Artificial Sequence
  Description of Artificial Sequence: Synthetic peptide
QAARP

SEQ ID NO: 6985 - protein, 5 aa, Artificial Sequence
  Description of Artificial Sequence: Synthetic peptide
TAARR

SEQ ID NO: 6986 - protein, 5 aa, Artificial Sequence
  Description of Artificial Sequence: Synthetic peptide
QAARL

SEQ ID NO: 6987 - protein, 5 aa, Artificial Sequence
  Description of Artificial Sequence: Synthetic peptide
KAARR

SEQ ID NO: 6988 - protein, 5 aa, Artificial Sequence
  Description of Artificial Sequence: Synthetic peptide
KAARP

SEQ ID NO: 6989 - protein, 5 aa, Artificial Sequence
  Description of Artificial Sequence: Synthetic peptide
KAARH

SEQ ID NO: 6990 - protein, 5 aa, Artificial Sequence
  Description of Artificial Sequence: Synthetic peptide
TAARH

SEQ ID NO: 6991 - protein, 5 aa, Artificial Sequence
  Description of Artificial Sequence: Synthetic peptide
TAARP

SEQ ID NO: 6992 - protein, 5 aa, Artificial Sequence
  Description of Artificial Sequence: Synthetic peptide
EAARL

SEQ ID NO: 6993 - protein, 5 aa, Artificial Sequence
  Description of Artificial Sequence: Synthetic peptide
EAARP

SEQ ID NO: 6994 - protein, 5 aa, Artificial Sequence
  Description of Artificial Sequence: Synthetic peptide
AAARL

SEQ ID NO: 6995 - protein, 5 aa, Artificial Sequence
  Description of Artificial Sequence: Synthetic peptide
LAARL

SEQ ID NO: 6996 - protein, 5 aa, Artificial Sequence
  Description of Artificial Sequence: Synthetic peptide
IAARL

SEQ ID NO: 6997 - protein, 5 aa, Artificial Sequence
  Description of Artificial Sequence: Synthetic peptide
IAARH

SEQ ID NO: 6998 - protein, 5 aa, Artificial Sequence
  Description of Artificial Sequence: Synthetic peptide
LAARR

SEQ ID NO: 6999 - protein, 5 aa, Artificial Sequence
  Description of Artificial Sequence: Synthetic peptide
LAARH

SEQ ID NO: 7000 - protein, 5 aa, Artificial Sequence
  Description of Artificial Sequence: Synthetic peptide
EAARH

SEQ ID NO: 7001 - protein, 5 aa, Artificial Sequence
  Description of Artificial Sequence: Synthetic peptide
IAARR

SEQ ID NO: 7002 - protein, 5 aa, Artificial Sequence
  Description of Artificial Sequence: Synthetic peptide
QAARR

SEQ ID NO: 7003 - protein, 5 aa, Artificial Sequence
  Description of Artificial Sequence: Synthetic peptide
EAARR

SEQ ID NO: 7004 - protein, 5 aa, Artificial Sequence
  Description of Artificial Sequence: Synthetic peptide
KAARL

SEQ ID NO: 7005 - protein, 5 aa, Artificial Sequence
  Description of Artificial Sequence: Synthetic peptide
PAARR

SEQ ID NO: 7006 - protein, 5 aa, Artificial Sequence
  Description of Artificial Sequence: Synthetic peptide
PAARP

SEQ ID NO: 7007 - protein, 5 aa, Artificial Sequence
  Description of Artificial Sequence: Synthetic peptide
PAARH

SEQ ID NO: 7008 - protein, 5 aa, Artificial Sequence
  Description of Artificial Sequence: Synthetic peptide
PAARL

SEQ ID NO: 7009 - protein, 5 aa, Artificial Sequence
  Description of Artificial Sequence: Synthetic peptide
VAARR

SEQ ID NO: 7010 - protein, 5 aa, Artificial Sequence
  Description of Artificial Sequence: Synthetic peptide
AAARH

SEQ ID NO: 7011 - protein, 5 aa, Artificial Sequence
  Description of Artificial Sequence: Synthetic peptide
VAARP

SEQ ID NO: 7012 - protein, 5 aa, Artificial Sequence
  Description of Artificial Sequence: Synthetic peptide
VAARH

SEQ ID NO: 7013 - protein, 5 aa, Artificial Sequence
  Description of Artificial Sequence: Synthetic peptide
AAARP

SEQ ID NO: 7014 - protein, 5 aa, Artificial Sequence
  Description of Artificial Sequence: Synthetic peptide
AAARR

SEQ ID NO: 7015 - protein, 5 aa, Artificial Sequence
  Description of Artificial Sequence: Synthetic peptide
TAARL

SEQ ID NO: 7016 - protein, 5 aa, Artificial Sequence
  Description of Artificial Sequence: Synthetic peptide
LAARP

SEQ ID NO: 7017 - protein, 5 aa, Artificial Sequence
  Description of Artificial Sequence: Synthetic peptide
VAARL

SEQ ID NO: 7018 - protein, 5 aa, Artificial Sequence
  Description of Artificial Sequence: Synthetic peptide
EYYYG

SEQ ID NO: 7019 - protein, 5 aa, Artificial Sequence
  Description of Artificial Sequence: Synthetic peptide
VYYYD

SEQ ID NO: 7020 - protein, 5 aa, Artificial Sequence
  Description of Artificial Sequence: Synthetic peptide
EYYYA

SEQ ID NO: 7021 - protein, 5 aa, Artificial Sequence
  Description of Artificial Sequence: Synthetic peptide
VYYYG

SEQ ID NO: 7022 - protein, 5 aa, Artificial Sequence
  Description of Artificial Sequence: Synthetic peptide
EYYYD

SEQ ID NO: 7023 - protein, 5 aa, Artificial Sequence
  Description of Artificial Sequence: Synthetic peptide
PYYYD

SEQ ID NO: 7024 - protein, 5 aa, Artificial Sequence
  Description of Artificial Sequence: Synthetic peptide
PYYYG

SEQ ID NO: 7025 - protein, 5 aa, Artificial Sequence
  Description of Artificial Sequence: Synthetic peptide
AYYYG

SEQ ID NO: 7026 - protein, 5 aa, Artificial Sequence
  Description of Artificial Sequence: Synthetic peptide
TYYYA

SEQ ID NO: 7027 - protein, 5 aa, Artificial Sequence
  Description of Artificial Sequence: Synthetic peptide
TYYYG

SEQ ID NO: 7028 - protein, 5 aa, Artificial Sequence
  Description of Artificial Sequence: Synthetic peptide
TYYYD

SEQ ID NO: 7029 - protein, 5 aa, Artificial Sequence
  Description of Artificial Sequence: Synthetic peptide
QYYYA

SEQ ID NO: 7030 - protein, 5 aa, Artificial Sequence
  Description of Artificial Sequence: Synthetic peptide
QYYYG

SEQ ID NO: 7031 - protein, 5 aa, Artificial Sequence
  Description of Artificial Sequence: Synthetic peptide
QYYYD

SEQ ID NO: 7032 - protein, 5 aa, Artificial Sequence
  Description of Artificial Sequence: Synthetic peptide
VYYYA

SEQ ID NO: 7033 - protein, 5 aa, Artificial Sequence
  Description of Artificial Sequence: Synthetic peptide
LYYYG

SEQ ID NO: 7034 - protein, 5 aa, Artificial Sequence
  Description of Artificial Sequence: Synthetic peptide
LYYYD

SEQ ID NO: 7035 - protein, 5 aa, Artificial Sequence
  Description of Artificial Sequence: Synthetic peptide
LYYYA

SEQ ID NO: 7036 - protein, 5 aa, Artificial Sequence
  Description of Artificial Sequence: Synthetic peptide
AYYYD

SEQ ID NO: 7037 - protein, 5 aa, Artificial Sequence
  Description of Artificial Sequence: Synthetic peptide
AYYYA

SEQ ID NO: 7038 - protein, 5 aa, Artificial Sequence
  Description of Artificial Sequence: Synthetic peptide
PYYYA

SEQ ID NO: 7039 - protein, 5 aa, Artificial Sequence
  Description of Artificial Sequence: Synthetic peptide
MYYYD

SEQ ID NO: 7040 - protein, 5 aa, Artificial Sequence
  Description of Artificial Sequence: Synthetic peptide
KYYYD

SEQ ID NO: 7041 - protein, 5 aa, Artificial Sequence
  Description of Artificial Sequence: Synthetic peptide
KYYYG

SEQ ID NO: 7042 - protein, 5 aa, Artificial Sequence
  Description of Artificial Sequence: Synthetic peptide
MYYYA

SEQ ID NO: 7043 - protein, 5 aa, Artificial Sequence
  Description of Artificial Sequence: Synthetic peptide
KYYYA

SEQ ID NO: 7044 - protein, 5 aa, Artificial Sequence
  Description of Artificial Sequence: Synthetic peptide
MYYYG

SEQ ID NO: 7045 - protein, 5 aa, Artificial Sequence
  Description of Artificial Sequence: Synthetic peptide
LTMVR

SEQ ID NO: 7046 - protein, 5 aa, Artificial Sequence
  Description of Artificial Sequence: Synthetic peptide
RTMVQ

SEQ ID NO: 7047 - protein, 5 aa, Artificial Sequence
  Description of Artificial Sequence: Synthetic peptide
VTMVQ

SEQ ID NO: 7048 - protein, 5 aa, Artificial Sequence
  Description of Artificial Sequence: Synthetic peptide
TTMVR

SEQ ID NO: 7049 - protein, 5 aa, Artificial Sequence
  Description of Artificial Sequence: Synthetic peptide
LTMVQ

SEQ ID NO: 7050 - protein, 5 aa, Artificial Sequence
  Description of Artificial Sequence: Synthetic peptide
STMVQ

SEQ ID NO: 7051 - protein, 5 aa, Artificial Sequence
  Description of Artificial Sequence: Synthetic peptide
ATMVQ

SEQ ID NO: 7052 - protein, 5 aa, Artificial Sequence
  Description of Artificial Sequence: Synthetic peptide
PTMVR

SEQ ID NO: 7053 - protein, 5 aa, Artificial Sequence
  Description of Artificial Sequence: Synthetic peptide
RTMVR

SEQ ID NO: 7054 - protein, 5 aa, Artificial Sequence
  Description of Artificial Sequence: Synthetic peptide
GTMVR

SEQ ID NO: 7055 - protein, 5 aa, Artificial Sequence
  Description of Artificial Sequence: Synthetic peptide
VTMVR

SEQ ID NO: 7056 - protein, 5 aa, Artificial Sequence
  Description of Artificial Sequence: Synthetic peptide
PTMVQ

SEQ ID NO: 7057 - protein, 5 aa, Artificial Sequence
  Description of Artificial Sequence: Synthetic peptide
ATMVR

SEQ ID NO: 7058 - protein, 5 aa, Artificial Sequence
  Description of Artificial Sequence: Synthetic peptide
STMVR

SEQ ID NO: 7059 - protein, 5 aa, Artificial Sequence
  Description of Artificial Sequence: Synthetic peptide
TTMVQ

SEQ ID NO: 7060 - protein, 5 aa, Artificial Sequence
  Description of Artificial Sequence: Synthetic peptide
GTMVQ

SEQ ID NO: 7061 - protein, 5 aa, Artificial Sequence
  Description of Artificial Sequence: Synthetic peptide
HMVQG

SEQ ID NO: 7062 - protein, 5 aa, Artificial Sequence
  Description of Artificial Sequence: Synthetic peptide
DMVQG

SEQ ID NO: 7063 - protein, 5 aa, Artificial Sequence
  Description of Artificial Sequence: Synthetic peptide
LMVQG

SEQ ID NO: 7064 - protein, 5 aa, Artificial Sequence
  Description of Artificial Sequence: Synthetic peptide
SMVQG

SEQ ID NO: 7065 - protein, 5 aa, Artificial Sequence
  Description of Artificial Sequence: Synthetic peptide
FMVQG

SEQ ID NO: 7066 - protein, 5 aa, Artificial Sequence
  Description of Artificial Sequence: Synthetic peptide
NMVQG

SEQ ID NO: 7067 - protein, 5 aa, Artificial Sequence
  Description of Artificial Sequence: Synthetic peptide
VMVQG

SEQ ID NO: 7068 - protein, 5 aa, Artificial Sequence
  Description of Artificial Sequence: Synthetic peptide
PMVQG

SEQ ID NO: 7069 - protein, 5 aa, Artificial Sequence
  Description of Artificial Sequence: Synthetic peptide
YMVQG

SEQ ID NO: 7070 - protein, 5 aa, Artificial Sequence
  Description of Artificial Sequence: Synthetic peptide
AMVQG

SEQ ID NO: 7071 - protein, 5 aa, Artificial Sequence
  Description of Artificial Sequence: Synthetic peptide
IMVQG

SEQ ID NO: 7072 - protein, 5 aa, Artificial Sequence
  Description of Artificial Sequence: Synthetic peptide
PWGSY

SEQ ID NO: 7073 - protein, 5 aa, Artificial Sequence
  Description of Artificial Sequence: Synthetic peptide
TWGSY

SEQ ID NO: 7074 - protein, 5 aa, Artificial Sequence
  Description of Artificial Sequence: Synthetic peptide
SWGSY

SEQ ID NO: 7075 - protein, 5 aa, Artificial Sequence
  Description of Artificial Sequence: Synthetic peptide
HWGSY

SEQ ID NO: 7076 - protein, 5 aa, Artificial Sequence
  Description of Artificial Sequence: Synthetic peptide
LWGSY

SEQ ID NO: 7077 - protein, 5 aa, Artificial Sequence
  Description of Artificial Sequence: Synthetic peptide
DWGSY

SEQ ID NO: 7078 - protein, 5 aa, Artificial Sequence
  Description of Artificial Sequence: Synthetic peptide
FWGSY

SEQ ID NO: 7079 - protein, 5 aa, Artificial Sequence
  Description of Artificial Sequence: Synthetic peptide
AWGSY

SEQ ID NO: 7080 - protein, 5 aa, Artificial Sequence
  Description of Artificial Sequence: Synthetic peptide
YWGSY

SEQ ID NO: 7081 - protein, 5 aa, Artificial Sequence
  Description of Artificial Sequence: Synthetic peptide
IWGSY

SEQ ID NO: 7082 - protein, 5 aa, Artificial Sequence
  Description of Artificial Sequence: Synthetic peptide
NWGSY

SEQ ID NO: 7083 - protein, 6 aa, Artificial Sequence
  Description of Artificial Sequence: Synthetic peptide
FSSSWF

SEQ ID NO: 7084 - protein, 6 aa, Artificial Sequence
  Description of Artificial Sequence: Synthetic peptide
HSSSWS

SEQ ID NO: 7085 - protein, 6 aa, Artificial Sequence
  Description of Artificial Sequence: Synthetic peptide
VSSSWF

SEQ ID NO: 7086 - protein, 6 aa, Artificial Sequence
  Description of Artificial Sequence: Synthetic peptide
HSSSWY

SEQ ID NO: 7087 - protein, 6 aa, Artificial Sequence
  Description of Artificial Sequence: Synthetic peptide
VSSSWS

SEQ ID NO: 7088 - protein, 6 aa, Artificial Sequence
  Description of Artificial Sequence: Synthetic peptide
LSSSWY

SEQ ID NO: 7089 - protein, 6 aa, Artificial Sequence
  Description of Artificial Sequence: Synthetic peptide
VSSSWY

SEQ ID NO: 7090 - protein, 6 aa, Artificial Sequence
  Description of Artificial Sequence: Synthetic peptide
HSSSWF

SEQ ID NO: 7091 - protein, 6 aa, Artificial Sequence
  Description of Artificial Sequence: Synthetic peptide
ASSSWY

SEQ ID NO: 7092 - protein, 6 aa, Artificial Sequence
  Description of Artificial Sequence: Synthetic peptide
DSSSWS

SEQ ID NO: 7093 - protein, 6 aa, Artificial Sequence
  Description of Artificial Sequence: Synthetic peptide
PSSSWY

SEQ ID NO: 7094 - protein, 6 aa, Artificial Sequence
  Description of Artificial Sequence: Synthetic peptide
ASSSWS

SEQ ID NO: 7095 - protein, 6 aa, Artificial Sequence
  Description of Artificial Sequence: Synthetic peptide
DSSSWF

SEQ ID NO: 7096 - protein, 6 aa, Artificial Sequence
  Description of Artificial Sequence: Synthetic peptide
DSSSWY

SEQ ID NO: 7097 - protein, 6 aa, Artificial Sequence
  Description of Artificial Sequence: Synthetic peptide
YSSSWS

SEQ ID NO: 7098 - protein, 6 aa, Artificial Sequence
  Description of Artificial Sequence: Synthetic peptide
YSSSWF

SEQ ID NO: 7099 - protein, 6 aa, Artificial Sequence
  Description of Artificial Sequence: Synthetic peptide
ASSSWF

SEQ ID NO: 7100 - protein, 6 aa, Artificial Sequence
  Description of Artificial Sequence: Synthetic peptide
LSSSWS

SEQ ID NO: 7101 - protein, 6 aa, Artificial Sequence
  Description of Artificial Sequence: Synthetic peptide
SSSSWS

SEQ ID NO: 7102 - protein, 6 aa, Artificial Sequence
  Description of Artificial Sequence: Synthetic peptide
PSSSWS

SEQ ID NO: 7103 - protein, 6 aa, Artificial Sequence
  Description of Artificial Sequence: Synthetic peptide
SSSSWY

SEQ ID NO: 7104 - protein, 6 aa, Artificial Sequence
  Description of Artificial Sequence: Synthetic peptide
LSSSWF

SEQ ID NO: 7105 - protein, 6 aa, Artificial Sequence
  Description of Artificial Sequence: Synthetic peptide
PSSSWF

SEQ ID NO: 7106 - protein, 6 aa, Artificial Sequence
  Description of Artificial Sequence: Synthetic peptide
FSSSWS

SEQ ID NO: 7107 - protein, 6 aa, Artificial Sequence
  Description of Artificial Sequence: Synthetic peptide
SSSSWF

SEQ ID NO: 7108 - protein, 6 aa, Artificial Sequence
  Description of Artificial Sequence: Synthetic peptide
FSSSWY

SEQ ID NO: 7109 - protein, 6 aa, Artificial Sequence
  Description of Artificial Sequence: Synthetic peptide
AYYDST

SEQ ID NO: 7110 - protein, 6 aa, Artificial Sequence
  Description of Artificial Sequence: Synthetic peptide
AYYDSI

SEQ ID NO: 7111 - protein, 6 aa, Artificial Sequence
  Description of Artificial Sequence: Synthetic peptide
YYYDST

SEQ ID NO: 7112 - protein, 6 aa, Artificial Sequence
  Description of Artificial Sequence: Synthetic peptide
PYYDST

SEQ ID NO: 7113 - protein, 6 aa, Artificial Sequence
  Description of Artificial Sequence: Synthetic peptide
VYYDSS

SEQ ID NO: 7114 - protein, 6 aa, Artificial Sequence
  Description of Artificial Sequence: Synthetic peptide
NYYDSI

SEQ ID NO: 7115 - protein, 6 aa, Artificial Sequence
  Description of Artificial Sequence: Synthetic peptide
PYYDSS

SEQ ID NO: 7116 - protein, 6 aa, Artificial Sequence
  Description of Artificial Sequence: Synthetic peptide
YYYDSI

SEQ ID NO: 7117 - protein, 6 aa, Artificial Sequence
  Description of Artificial Sequence: Synthetic peptide
VYYDST

SEQ ID NO: 7118 - protein, 6 aa, Artificial Sequence
  Description of Artificial Sequence: Synthetic peptide
VYYDSI

SEQ ID NO: 7119 - protein, 6 aa, Artificial Sequence
  Description of Artificial Sequence: Synthetic peptide
NYYDST

SEQ ID NO: 7120 - protein, 6 aa, Artificial Sequence
  Description of Artificial Sequence: Synthetic peptide
LYYDST

SEQ ID NO: 7121 - protein, 6 aa, Artificial Sequence
  Description of Artificial Sequence: Synthetic peptide
NYYDSS

SEQ ID NO: 7122 - protein, 6 aa, Artificial Sequence
  Description of Artificial Sequence: Synthetic peptide
SYYDSI

SEQ ID NO: 7123 - protein, 6 aa, Artificial Sequence
  Description of Artificial Sequence: Synthetic peptide
LYYDSS

SEQ ID NO: 7124 - protein, 6 aa, Artificial Sequence
  Description of Artificial Sequence: Synthetic peptide
SYYDST

SEQ ID NO: 7125 - protein, 6 aa, Artificial Sequence
  Description of Artificial Sequence: Synthetic peptide
LYYDSI

SEQ ID NO: 7126 - protein, 6 aa, Artificial Sequence
  Description of Artificial Sequence: Synthetic peptide
SYYDSS

SEQ ID NO: 7127 - protein, 6 aa, Artificial Sequence
  Description of Artificial Sequence: Synthetic peptide
DYYDSI

SEQ ID NO: 7128 - protein, 6 aa, Artificial Sequence
  Description of Artificial Sequence: Synthetic peptide
DYYDST

SEQ ID NO: 7129 - protein, 6 aa, Artificial Sequence
  Description of Artificial Sequence: Synthetic peptide
DYYDSS

SEQ ID NO: 7130 - protein, 6 aa, Artificial Sequence
  Description of Artificial Sequence: Synthetic peptide
FYYDSS

SEQ ID NO: 7131 - protein, 6 aa, Artificial Sequence
  Description of Artificial Sequence: Synthetic peptide
TYYDSI

SEQ ID NO: 7132 - protein, 6 aa, Artificial Sequence
  Description of Artificial Sequence: Synthetic peptide
FYYDST

SEQ ID NO: 7133 - protein, 6 aa, Artificial Sequence
  Description of Artificial Sequence: Synthetic peptide
IYYDST

SEQ ID NO: 7134 - protein, 6 aa, Artificial Sequence
  Description of Artificial Sequence: Synthetic peptide
FYYDSI

SEQ ID NO: 7135 - protein, 6 aa, Artificial Sequence
  Description of Artificial Sequence: Synthetic peptide
IYYDSS

SEQ ID NO: 7136 - protein, 6 aa, Artificial Sequence
  Description of Artificial Sequence: Synthetic peptide
TYYDSS

SEQ ID NO: 7137 - protein, 6 aa, Artificial Sequence
  Description of Artificial Sequence: Synthetic peptide
TYYDST

SEQ ID NO: 7138 - protein, 6 aa, Artificial Sequence
  Description of Artificial Sequence: Synthetic peptide
HYYDSS

SEQ ID NO: 7139 - protein, 6 aa, Artificial Sequence
  Description of Artificial Sequence: Synthetic peptide
HYYDST

SEQ ID NO: 7140 - protein, 6 aa, Artificial Sequence
  Description of Artificial Sequence: Synthetic peptide
IYYDSI

SEQ ID NO: 7141 - protein, 6 aa, Artificial Sequence
  Description of Artificial Sequence: Synthetic peptide
HYYDSI

SEQ ID NO: 7142 - protein, 6 aa, Artificial Sequence
  Description of Artificial Sequence: Synthetic peptide
PYYDSI

SEQ ID NO: 7143 - protein, 6 aa, Artificial Sequence
  Description of Artificial Sequence: Synthetic peptide
AYYDSS

SEQ ID NO: 7144 - protein, 6 aa, Artificial Sequence
  Description of Artificial Sequence: Synthetic peptide
LYSGYA

SEQ ID NO: 7145 - protein, 6 aa, Artificial Sequence
  Description of Artificial Sequence: Synthetic peptide
GYSGYV

SEQ ID NO: 7146 - protein, 6 aa, Artificial Sequence
  Description of Artificial Sequence: Synthetic peptide
SYSGYD

SEQ ID NO: 7147 - protein, 6 aa, Artificial Sequence
  Description of Artificial Sequence: Synthetic peptide
LYSGYD

SEQ ID NO: 7148 - protein, 6 aa, Artificial Sequence
  Description of Artificial Sequence: Synthetic peptide
IYSGYV

SEQ ID NO: 7149 - protein, 6 aa, Artificial Sequence
  Description of Artificial Sequence: Synthetic peptide
SYSGYG

SEQ ID NO: 7150 - protein, 6 aa, Artificial Sequence
  Description of Artificial Sequence: Synthetic peptide
IYSGYG

SEQ ID NO: 7151 - protein, 6 aa, Artificial Sequence
  Description of Artificial Sequence: Synthetic peptide
SYSGYA

SEQ ID NO: 7152 - protein, 6 aa, Artificial Sequence
  Description of Artificial Sequence: Synthetic peptide
PYSGYG

SEQ ID NO: 7153 - protein, 6 aa, Artificial Sequence
  Description of Artificial Sequence: Synthetic peptide
VYSGYD

SEQ ID NO: 7154 - protein, 6 aa, Artificial Sequence
  Description of Artificial Sequence: Synthetic peptide
PYSGYA

SEQ ID NO: 7155 - protein, 6 aa, Artificial Sequence
  Description of Artificial Sequence: Synthetic peptide
VYSGYV

SEQ ID NO: 7156 - protein, 6 aa, Artificial Sequence
  Description of Artificial Sequence: Synthetic peptide
GYSGYG

SEQ ID NO: 7157 - protein, 6 aa, Artificial Sequence
  Description of Artificial Sequence: Synthetic peptide
VYSGYA

SEQ ID NO: 7158 - protein, 6 aa, Artificial Sequence
  Description of Artificial Sequence: Synthetic peptide
PYSGYV

SEQ ID NO: 7159 - protein, 6 aa, Artificial Sequence
  Description of Artificial Sequence: Synthetic peptide
GYSGYA

SEQ ID NO: 7160 - protein, 6 aa, Artificial Sequence
  Description of Artificial Sequence: Synthetic peptide
IYSGYD

SEQ ID NO: 7161 - protein, 6 aa, Artificial Sequence
  Description of Artificial Sequence: Synthetic peptide
PYSGYD

SEQ ID NO: 7162 - protein, 6 aa, Artificial Sequence
  Description of Artificial Sequence: Synthetic peptide
RYSGYV

SEQ ID NO: 7163 - protein, 6 aa, Artificial Sequence
  Description of Artificial Sequence: Synthetic peptide
RYSGYA

SEQ ID NO: 7164 - protein, 6 aa, Artificial Sequence
  Description of Artificial Sequence: Synthetic peptide
RYSGYG

SEQ ID NO: 7165 - protein, 6 aa, Artificial Sequence
  Description of Artificial Sequence: Synthetic peptide
IYSGYA

SEQ ID NO: 7166 - protein, 6 aa, Artificial Sequence
  Description of Artificial Sequence: Synthetic peptide
AYSGYA

SEQ ID NO: 7167 - protein, 6 aa, Artificial Sequence
  Description of Artificial Sequence: Synthetic peptide
RYSGYD

SEQ ID NO: 7168 - protein, 6 aa, Artificial Sequence
  Description of Artificial Sequence: Synthetic peptide
AYSGYG

SEQ ID NO: 7169 - protein, 6 aa, Artificial Sequence
  Description of Artificial Sequence: Synthetic peptide
AYSGYD

SEQ ID NO: 7170 - protein, 6 aa, Artificial Sequence
  Description of Artificial Sequence: Synthetic peptide
AYSGYV

SEQ ID NO: 7171 - protein, 6 aa, Artificial Sequence
  Description of Artificial Sequence: Synthetic peptide
VYSGYG

SEQ ID NO: 7172 - protein, 6 aa, Artificial Sequence
  Description of Artificial Sequence: Synthetic peptide
TYSGYV

SEQ ID NO: 7173 - protein, 6 aa, Artificial Sequence
  Description of Artificial Sequence: Synthetic peptide
TYSGYD

SEQ ID NO: 7174 - protein, 6 aa, Artificial Sequence
  Description of Artificial Sequence: Synthetic peptide
TYSGYA

SEQ ID NO: 7175 - protein, 6 aa, Artificial Sequence
  Description of Artificial Sequence: Synthetic peptide
TYSGYG

SEQ ID NO: 7176 - protein, 6 aa, Artificial Sequence
  Description of Artificial Sequence: Synthetic peptide
SYSGYV

SEQ ID NO: 7177 - protein, 6 aa, Artificial Sequence
  Description of Artificial Sequence: Synthetic peptide
LYSGYV

SEQ ID NO: 7178 - protein, 6 aa, Artificial Sequence
  Description of Artificial Sequence: Synthetic peptide
LYSGYG

SEQ ID NO: 7179 - protein, 6 aa, Artificial Sequence
  Description of Artificial Sequence: Synthetic peptide
SSSGWF

SEQ ID NO: 7180 - protein, 6 aa, Artificial Sequence
  Description of Artificial Sequence: Synthetic peptide
PSSGWY

SEQ ID NO: 7181 - protein, 6 aa, Artificial Sequence
  Description of Artificial Sequence: Synthetic peptide
FSSGWF

SEQ ID NO: 7182 - protein, 6 aa, Artificial Sequence
  Description of Artificial Sequence: Synthetic peptide
PSSGWS

SEQ ID NO: 7183 - protein, 6 aa, Artificial Sequence
  Description of Artificial Sequence: Synthetic peptide
FSSGWS

SEQ ID NO: 7184 - protein, 6 aa, Artificial Sequence
  Description of Artificial Sequence: Synthetic peptide
ASSGWY

SEQ ID NO: 7185 - protein, 6 aa, Artificial Sequence
  Description of Artificial Sequence: Synthetic peptide
FSSGWY

SEQ ID NO: 7186 - protein, 6 aa, Artificial Sequence
  Description of Artificial Sequence: Synthetic peptide
ASSGWS

SEQ ID NO: 7187 - protein, 6 aa, Artificial Sequence
  Description of Artificial Sequence: Synthetic peptide
SSSGWS

SEQ ID NO: 7188 - protein, 6 aa, Artificial Sequence
  Description of Artificial Sequence: Synthetic peptide
SSSGWY

SEQ ID NO: 7189 - protein, 6 aa, Artificial Sequence
  Description of Artificial Sequence: Synthetic peptide
HSSGWS

SEQ ID NO: 7190 - protein, 6 aa, Artificial Sequence
  Description of Artificial Sequence: Synthetic peptide
DSSGWS

SEQ ID NO: 7191 - protein, 6 aa, Artificial Sequence
  Description of Artificial Sequence: Synthetic peptide
YSSGWS

SEQ ID NO: 7192 - protein, 6 aa, Artificial Sequence
  Description of Artificial Sequence: Synthetic peptide
LSSGWF

SEQ ID NO: 7193 - protein, 6 aa, Artificial Sequence
  Description of Artificial Sequence: Synthetic peptide
HSSGWY

SEQ ID NO: 7194 - protein, 6 aa, Artificial Sequence
  Description of Artificial Sequence: Synthetic peptide
DSSGWF

SEQ ID NO: 7195 - protein, 6 aa, Artificial Sequence
  Description of Artificial Sequence: Synthetic peptide
DSSGWY

SEQ ID NO: 7196 - protein, 6 aa, Artificial Sequence
  Description of Artificial Sequence: Synthetic peptide
LSSGWY

SEQ ID NO: 7197 - protein, 6 aa, Artificial Sequence
  Description of Artificial Sequence: Synthetic peptide
HSSGWF

SEQ ID NO: 7198 - protein, 6 aa, Artificial Sequence
  Description of Artificial Sequence: Synthetic peptide
VSSGWS

SEQ ID NO: 7199 - protein, 6 aa, Artificial Sequence
  Description of Artificial Sequence: Synthetic peptide
LSSGWS

SEQ ID NO: 7200 - protein, 6 aa, Artificial Sequence
  Description of Artificial Sequence: Synthetic peptide
VSSGWY

SEQ ID NO: 7201 - protein, 6 aa, Artificial Sequence
  Description of Artificial Sequence: Synthetic peptide
VSSGWF

SEQ ID NO: 7202 - protein, 6 aa, Artificial Sequence
  Description of Artificial Sequence: Synthetic peptide
PSSGWF

SEQ ID NO: 7203 - protein, 6 aa, Artificial Sequence
  Description of Artificial Sequence: Synthetic peptide
ASSGWF

SEQ ID NO: 7204 - protein, 6 aa, Artificial Sequence
  Description of Artificial Sequence: Synthetic peptide
YSSGWF

SEQ ID NO: 7205 - protein, 6 aa, Artificial Sequence
  Description of Artificial Sequence: Synthetic peptide
IYYGSA

SEQ ID NO: 7206 - protein, 6 aa, Artificial Sequence
  Description of Artificial Sequence: Synthetic peptide
PYYGSG

SEQ ID NO: 7207 - protein, 6 aa, Artificial Sequence
  Description of Artificial Sequence: Synthetic peptide
PYYGSA

SEQ ID NO: 7208 - protein, 6 aa, Artificial Sequence
  Description of Artificial Sequence: Synthetic peptide
PYYGSD

SEQ ID NO: 7209 - protein, 6 aa, Artificial Sequence
  Description of Artificial Sequence: Synthetic peptide
VYYGSD

SEQ ID NO: 7210 - protein, 6 aa, Artificial Sequence
  Description of Artificial Sequence: Synthetic peptide
AYYGSA

SEQ ID NO: 7211 - protein, 6 aa, Artificial Sequence
  Description of Artificial Sequence: Synthetic peptide
VYYGSA

SEQ ID NO: 7212 - protein, 6 aa, Artificial Sequence
  Description of Artificial Sequence: Synthetic peptide
NYYGSA

SEQ ID NO: 7213 - protein, 6 aa, Artificial Sequence
  Description of Artificial Sequence: Synthetic peptide
YYYGSA

SEQ ID NO: 7214 - protein, 6 aa, Artificial Sequence
  Description of Artificial Sequence: Synthetic peptide
AYYGSD

SEQ ID NO: 7215 - protein, 6 aa, Artificial Sequence
  Description of Artificial Sequence: Synthetic peptide
NYYGSD

SEQ ID NO: 7216 - protein, 6 aa, Artificial Sequence
  Description of Artificial Sequence: Synthetic peptide
YYYGSD

SEQ ID NO: 7217 - protein, 6 aa, Artificial Sequence
  Description of Artificial Sequence: Synthetic peptide
FYYGSD

SEQ ID NO: 7218 - protein, 6 aa, Artificial Sequence
  Description of Artificial Sequence: Synthetic peptide
NYYGSG

SEQ ID NO: 7219 - protein, 6 aa, Artificial Sequence
  Description of Artificial Sequence: Synthetic peptide
FYYGSA

SEQ ID NO: 7220 - protein, 6 aa, Artificial Sequence
  Description of Artificial Sequence: Synthetic peptide
FYYGSG

SEQ ID NO: 7221 - protein, 6 aa, Artificial Sequence
  Description of Artificial Sequence: Synthetic peptide
AYYGSG

SEQ ID NO: 7222 - protein, 6 aa, Artificial Sequence
  Description of Artificial Sequence: Synthetic peptide
LYYGSG

SEQ ID NO: 7223 - protein, 6 aa, Artificial Sequence
  Description of Artificial Sequence: Synthetic peptide
DYYGSD

SEQ ID NO: 7224 - protein, 6 aa, Artificial Sequence
  Description of Artificial Sequence: Synthetic peptide
LYYGSA

SEQ ID NO: 7225 - protein, 6 aa, Artificial Sequence
  Description of Artificial Sequence: Synthetic peptide
TYYGSD

SEQ ID NO: 7226 - protein, 6 aa, Artificial Sequence
  Description of Artificial Sequence: Synthetic peptide
DYYGSG

SEQ ID NO: 7227 - protein, 6 aa, Artificial Sequence
  Description of Artificial Sequence: Synthetic peptide
DYYGSA

SEQ ID NO: 7228 - protein, 6 aa, Artificial Sequence
  Description of Artificial Sequence: Synthetic peptide
LYYGSD

SEQ ID NO: 7229 - protein, 6 aa, Artificial Sequence
  Description of Artificial Sequence: Synthetic peptide
HYYGSD

SEQ ID NO: 7230 - protein, 6 aa, Artificial Sequence
  Description of Artificial Sequence: Synthetic peptide
TYYGSA

SEQ ID NO: 7231 - protein, 6 aa, Artificial Sequence
  Description of Artificial Sequence: Synthetic peptide
TYYGSG

SEQ ID NO: 7232 - protein, 6 aa, Artificial Sequence
  Description of Artificial Sequence: Synthetic peptide
HYYGSA

SEQ ID NO: 7233 - protein, 6 aa, Artificial Sequence
  Description of Artificial Sequence: Synthetic peptide
SYYGSG

SEQ ID NO: 7234 - protein, 6 aa, Artificial Sequence
  Description of Artificial Sequence: Synthetic peptide
HYYGSG

SEQ ID NO: 7235 - protein, 6 aa, Artificial Sequence
  Description of Artificial Sequence: Synthetic peptide
SYYGSD

SEQ ID NO: 7236 - protein, 6 aa, Artificial Sequence
  Description of Artificial Sequence: Synthetic peptide
VYYGSG

SEQ ID NO: 7237 - protein, 6 aa, Artificial Sequence
  Description of Artificial Sequence: Synthetic peptide
SYYGSA

SEQ ID NO: 7238 - protein, 6 aa, Artificial Sequence
  Description of Artificial Sequence: Synthetic peptide
IYYGSG

SEQ ID NO: 7239 - protein, 6 aa, Artificial Sequence
  Description of Artificial Sequence: Synthetic peptide
IYYGSD

SEQ ID NO: 7240 - protein, 6 aa, Artificial Sequence
  Description of Artificial Sequence: Synthetic peptide
VSSGYS

SEQ ID NO: 7241 - protein, 6 aa, Artificial Sequence
  Description of Artificial Sequence: Synthetic peptide
VSSGYY

SEQ ID NO: 7242 - protein, 6 aa, Artificial Sequence
  Description of Artificial Sequence: Synthetic peptide
FSSGYY

SEQ ID NO: 7243 - protein, 6 aa, Artificial Sequence
  Description of Artificial Sequence: Synthetic peptide
ASSGYF

SEQ ID NO: 7244 - protein, 6 aa, Artificial Sequence
  Description of Artificial Sequence: Synthetic peptide
ASSGYS

SEQ ID NO: 7245 - protein, 6 aa, Artificial Sequence
  Description of Artificial Sequence: Synthetic peptide
FSSGYS

SEQ ID NO: 7246 - protein, 6 aa, Artificial Sequence
  Description of Artificial Sequence: Synthetic peptide
SSSGYY

SEQ ID NO: 7247 - protein, 6 aa, Artificial Sequence
  Description of Artificial Sequence: Synthetic peptide
ASSGYY

SEQ ID NO: 7248 - protein, 6 aa, Artificial Sequence
  Description of Artificial Sequence: Synthetic peptide
FSSGYF

SEQ ID NO: 7249 - protein, 6 aa, Artificial Sequence
  Description of Artificial Sequence: Synthetic peptide
HSSGYY

SEQ ID NO: 7250 - protein, 6 aa, Artificial Sequence
  Description of Artificial Sequence: Synthetic peptide
HSSGYS

SEQ ID NO: 7251 - protein, 6 aa, Artificial Sequence
  Description of Artificial Sequence: Synthetic peptide
SSSGYS

SEQ ID NO: 7252 - protein, 6 aa, Artificial Sequence
  Description of Artificial Sequence: Synthetic peptide
DSSGYS

SEQ ID NO: 7253 - protein, 6 aa, Artificial Sequence
  Description of Artificial Sequence: Synthetic peptide
DSSGYF

SEQ ID NO: 7254 - protein, 6 aa, Artificial Sequence
  Description of Artificial Sequence: Synthetic peptide
HSSGYF

SEQ ID NO: 7255 - protein, 6 aa, Artificial Sequence
  Description of Artificial Sequence: Synthetic peptide
PSSGYF

SEQ ID NO: 7256 - protein, 6 aa, Artificial Sequence
  Description of Artificial Sequence: Synthetic peptide
SSSGYF

SEQ ID NO: 7257 - protein, 6 aa, Artificial Sequence
  Description of Artificial Sequence: Synthetic peptide
YSSGYY

SEQ ID NO: 7258 - protein, 6 aa, Artificial Sequence
  Description of Artificial Sequence: Synthetic peptide
YSSGYF

SEQ ID NO: 7259 - protein, 6 aa, Artificial Sequence
  Description of Artificial Sequence: Synthetic peptide
YSSGYS

SEQ ID NO: 7260 - protein, 6 aa, Artificial Sequence
  Description of Artificial Sequence: Synthetic peptide
PSSGYS

SEQ ID NO: 7261 - protein, 6 aa, Artificial Sequence
  Description of Artificial Sequence: Synthetic peptide
PSSGYY

SEQ ID NO: 7262 - protein, 6 aa, Artificial Sequence
  Description of Artificial Sequence: Synthetic peptide
LSSGYY

SEQ ID NO: 7263 - protein, 6 aa, Artificial Sequence
  Description of Artificial Sequence: Synthetic peptide
LSSGYF

SEQ ID NO: 7264 - protein, 6 aa, Artificial Sequence
  Description of Artificial Sequence: Synthetic peptide
LSSGYS

SEQ ID NO: 7265 - protein, 6 aa, Artificial Sequence
  Description of Artificial Sequence: Synthetic peptide
VSSGYF

SEQ ID NO: 7266 - protein, 6 aa, Artificial Sequence
  Description of Artificial Sequence: Synthetic peptide
TYDSSD

SEQ ID NO: 7267 - protein, 6 aa, Artificial Sequence
  Description of Artificial Sequence: Synthetic peptide
YYDSSA

SEQ ID NO: 7268 - protein, 6 aa, Artificial Sequence
  Description of Artificial Sequence: Synthetic peptide
LYDSSD

SEQ ID NO: 7269 - protein, 6 aa, Artificial Sequence
  Description of Artificial Sequence: Synthetic peptide
LYDSSA

SEQ ID NO: 7270 - protein, 6 aa, Artificial Sequence
  Description of Artificial Sequence: Synthetic peptide
PYDSSA

SEQ ID NO: 7271 - protein, 6 aa, Artificial Sequence
  Description of Artificial Sequence: Synthetic peptide
LYDSSG

SEQ ID NO: 7272 - protein, 6 aa, Artificial Sequence
  Description of Artificial Sequence: Synthetic peptide
PYDSSD

SEQ ID NO: 7273 - protein, 6 aa, Artificial Sequence
  Description of Artificial Sequence: Synthetic peptide
VYDSSD

SEQ ID NO: 7274 - protein, 6 aa, Artificial Sequence
  Description of Artificial Sequence: Synthetic peptide
HYDSSG

SEQ ID NO: 7275 - protein, 6 aa, Artificial Sequence
  Description of Artificial Sequence: Synthetic peptide
VYDSSG

SEQ ID NO: 7276 - protein, 6 aa, Artificial Sequence
  Description of Artificial Sequence: Synthetic peptide
VYDSSA

SEQ ID NO: 7277 - protein, 6 aa, Artificial Sequence
  Description of Artificial Sequence: Synthetic peptide
PYDSSG

SEQ ID NO: 7278 - protein, 6 aa, Artificial Sequence
  Description of Artificial Sequence: Synthetic peptide
SYDSSA

SEQ ID NO: 7279 - protein, 6 aa, Artificial Sequence
  Description of Artificial Sequence: Synthetic peptide
FYDSSG

SEQ ID NO: 7280 - protein, 6 aa, Artificial Sequence
  Description of Artificial Sequence: Synthetic peptide
NYDSSA

SEQ ID NO: 7281 - protein, 6 aa, Artificial Sequence
  Description of Artificial Sequence: Synthetic peptide
SYDSSG

SEQ ID NO: 7282 - protein, 6 aa, Artificial Sequence
  Description of Artificial Sequence: Synthetic peptide
FYDSSA

SEQ ID NO: 7283 - protein, 6 aa, Artificial Sequence
  Description of Artificial Sequence: Synthetic peptide
NYDSSD

SEQ ID NO: 7284 - protein, 6 aa, Artificial Sequence
  Description of Artificial Sequence: Synthetic peptide
SYDSSD

SEQ ID NO: 7285 - protein, 6 aa, Artificial Sequence
  Description of Artificial Sequence: Synthetic peptide
FYDSSD

SEQ ID NO: 7286 - protein, 6 aa, Artificial Sequence
  Description of Artificial Sequence: Synthetic peptide
DYDSSG

SEQ ID NO: 7287 - protein, 6 aa, Artificial Sequence
  Description of Artificial Sequence: Synthetic peptide
AYDSSG

SEQ ID NO: 7288 - protein, 6 aa, Artificial Sequence
  Description of Artificial Sequence: Synthetic peptide
NYDSSG

SEQ ID NO: 7289 - protein, 6 aa, Artificial Sequence
  Description of Artificial Sequence: Synthetic peptide
IYDSSA

SEQ ID NO: 7290 - protein, 6 aa, Artificial Sequence
  Description of Artificial Sequence: Synthetic peptide
DYDSSD

SEQ ID NO: 7291 - protein, 6 aa, Artificial Sequence
  Description of Artificial Sequence: Synthetic peptide
IYDSSG

SEQ ID NO: 7292 - protein, 6 aa, Artificial Sequence
  Description of Artificial Sequence: Synthetic peptide
AYDSSD

SEQ ID NO: 7293 - protein, 6 aa, Artificial Sequence
  Description of Artificial Sequence: Synthetic peptide
DYDSSA

SEQ ID NO: 7294 - protein, 6 aa, Artificial Sequence
  Description of Artificial Sequence: Synthetic peptide
IYDSSD

SEQ ID NO: 7295 - protein, 6 aa, Artificial Sequence
  Description of Artificial Sequence: Synthetic peptide
HYDSSA

SEQ ID NO: 7296 - protein, 6 aa, Artificial Sequence
  Description of Artificial Sequence: Synthetic peptide
AYDSSA

SEQ ID NO: 7297 - protein, 6 aa, Artificial Sequence
  Description of Artificial Sequence: Synthetic peptide
HYDSSD

SEQ ID NO: 7298 - protein, 6 aa, Artificial Sequence
  Description of Artificial Sequence: Synthetic peptide
TYDSSG

SEQ ID NO: 7299 - protein, 6 aa, Artificial Sequence
  Description of Artificial Sequence: Synthetic peptide
TYDSSA

SEQ ID NO: 7300 - protein, 6 aa, Artificial Sequence
  Description of Artificial Sequence: Synthetic peptide
YYDSSD

SEQ ID NO: 7301 - protein, 6 aa, Artificial Sequence
  Description of Artificial Sequence: Synthetic peptide
TDFWSA

SEQ ID NO: 7302 - protein, 6 aa, Artificial Sequence
  Description of Artificial Sequence: Synthetic peptide
ADFWSG

SEQ ID NO: 7303 - protein, 6 aa, Artificial Sequence
  Description of Artificial Sequence: Synthetic peptide
PDFWSG

SEQ ID NO: 7304 - protein, 6 aa, Artificial Sequence
  Description of Artificial Sequence: Synthetic peptide
VDFWSD

SEQ ID NO: 7305 - protein, 6 aa, Artificial Sequence
  Description of Artificial Sequence: Synthetic peptide
TDFWSD

SEQ ID NO: 7306 - protein, 6 aa, Artificial Sequence
  Description of Artificial Sequence: Synthetic peptide
HDFWSA

SEQ ID NO: 7307 - protein, 6 aa, Artificial Sequence
  Description of Artificial Sequence: Synthetic peptide
HDFWSD

SEQ ID NO: 7308 - protein, 6 aa, Artificial Sequence
  Description of Artificial Sequence: Synthetic peptide
TDFWSG

SEQ ID NO: 7309 - protein, 6 aa, Artificial Sequence
  Description of Artificial Sequence: Synthetic peptide
LDFWSA

SEQ ID NO: 7310 - protein, 6 aa, Artificial Sequence
  Description of Artificial Sequence: Synthetic peptide
LDFWSG

SEQ ID NO: 7311 - protein, 6 aa, Artificial Sequence
  Description of Artificial Sequence: Synthetic peptide
HDFWSG

SEQ ID NO: 7312 - protein, 6 aa, Artificial Sequence
  Description of Artificial Sequence: Synthetic peptide
LDFWSD

SEQ ID NO: 7313 - protein, 6 aa, Artificial Sequence
  Description of Artificial Sequence: Synthetic peptide
FDFWSG

SEQ ID NO: 7314 - protein, 6 aa, Artificial Sequence
  Description of Artificial Sequence: Synthetic peptide
DDFWSD

SEQ ID NO: 7315 - protein, 6 aa, Artificial Sequence
  Description of Artificial Sequence: Synthetic peptide
VDFWSA

SEQ ID NO: 7316 - protein, 6 aa, Artificial Sequence
  Description of Artificial Sequence: Synthetic peptide
SDFWSD

SEQ ID NO: 7317 - protein, 6 aa, Artificial Sequence
  Description of Artificial Sequence: Synthetic peptide
SDFWSG

SEQ ID NO: 7318 - protein, 6 aa, Artificial Sequence
  Description of Artificial Sequence: Synthetic peptide
NDFWSD

SEQ ID NO: 7319 - protein, 6 aa, Artificial Sequence
  Description of Artificial Sequence: Synthetic peptide
SDFWSA

SEQ ID NO: 7320 - protein, 6 aa, Artificial Sequence
  Description of Artificial Sequence: Synthetic peptide
NDFWSA

SEQ ID NO: 7321 - protein, 6 aa, Artificial Sequence
  Description of Artificial Sequence: Synthetic peptide
NDFWSG

SEQ ID NO: 7322 - protein, 6 aa, Artificial Sequence
  Description of Artificial Sequence: Synthetic peptide
VDFWSG

SEQ ID NO: 7323 - protein, 6 aa, Artificial Sequence
  Description of Artificial Sequence: Synthetic peptide
IDFWSD

SEQ ID NO: 7324 - protein, 6 aa, Artificial Sequence
  Description of Artificial Sequence: Synthetic peptide
IDFWSG

SEQ ID NO: 7325 - protein, 6 aa, Artificial Sequence
  Description of Artificial Sequence: Synthetic peptide
FDFWSA

SEQ ID NO: 7326 - protein, 6 aa, Artificial Sequence
  Description of Artificial Sequence: Synthetic peptide
ADFWSD

SEQ ID NO: 7327 - protein, 6 aa, Artificial Sequence
  Description of Artificial Sequence: Synthetic peptide
IDFWSA

SEQ ID NO: 7328 - protein, 6 aa, Artificial Sequence
  Description of Artificial Sequence: Synthetic peptide
FDFWSD

SEQ ID NO: 7329 - protein, 6 aa, Artificial Sequence
  Description of Artificial Sequence: Synthetic peptide
DDFWSG

SEQ ID NO: 7330 - protein, 6 aa, Artificial Sequence
  Description of Artificial Sequence: Synthetic peptide
ADFWSA

SEQ ID NO: 7331 - protein, 6 aa, Artificial Sequence
  Description of Artificial Sequence: Synthetic peptide
YDFWSA

SEQ ID NO: 7332 - protein, 6 aa, Artificial Sequence
  Description of Artificial Sequence: Synthetic peptide
PDFWSD

SEQ ID NO: 7333 - protein, 6 aa, Artificial Sequence
  Description of Artificial Sequence: Synthetic peptide
DDFWSA

SEQ ID NO: 7334 - protein, 6 aa, Artificial Sequence
  Description of Artificial Sequence: Synthetic peptide
PDFWSA

SEQ ID NO: 7335 - protein, 6 aa, Artificial Sequence
  Description of Artificial Sequence: Synthetic peptide
YDFWSD

SEQ ID NO: 7336 - protein, 6 aa, Artificial Sequence
  Description of Artificial Sequence: Synthetic peptide
DDSSGY

SEQ ID NO: 7337 - protein, 6 aa, Artificial Sequence
  Description of Artificial Sequence: Synthetic peptide
LDSSGY

SEQ ID NO: 7338 - protein, 6 aa, Artificial Sequence
  Description of Artificial Sequence: Synthetic peptide
HDSSGS

SEQ ID NO: 7339 - protein, 6 aa, Artificial Sequence
  Description of Artificial Sequence: Synthetic peptide
DDSSGF

SEQ ID NO: 7340 - protein, 6 aa, Artificial Sequence
  Description of Artificial Sequence: Synthetic peptide
DDSSGS

SEQ ID NO: 7341 - protein, 6 aa, Artificial Sequence
  Description of Artificial Sequence: Synthetic peptide
LDSSGS

SEQ ID NO: 7342 - protein, 6 aa, Artificial Sequence
  Description of Artificial Sequence: Synthetic peptide
HDSSGY

SEQ ID NO: 7343 - protein, 6 aa, Artificial Sequence
  Description of Artificial Sequence: Synthetic peptide
SDSSGS

SEQ ID NO: 7344 - protein, 6 aa, Artificial Sequence
  Description of Artificial Sequence: Synthetic peptide
SDSSGF

SEQ ID NO: 7345 - protein, 6 aa, Artificial Sequence
  Description of Artificial Sequence: Synthetic peptide
PDSSGS

SEQ ID NO: 7346 - protein, 6 aa, Artificial Sequence
  Description of Artificial Sequence: Synthetic peptide
SDSSGY

SEQ ID NO: 7347 - protein, 6 aa, Artificial Sequence
  Description of Artificial Sequence: Synthetic peptide
PDSSGY

SEQ ID NO: 7348 - protein, 6 aa, Artificial Sequence
  Description of Artificial Sequence: Synthetic peptide
ADSSGY

SEQ ID NO: 7349 - protein, 6 aa, Artificial Sequence
  Description of Artificial Sequence: Synthetic peptide
ADSSGS

SEQ ID NO: 7350 - protein, 6 aa, Artificial Sequence
  Description of Artificial Sequence: Synthetic peptide
ADSSGF

SEQ ID NO: 7351 - protein, 6 aa, Artificial Sequence
  Description of Artificial Sequence: Synthetic peptide
YDSSGF

SEQ ID NO: 7352 - protein, 6 aa, Artificial Sequence
  Description of Artificial Sequence: Synthetic peptide
VDSSGF

SEQ ID NO: 7353 - protein, 6 aa, Artificial Sequence
  Description of Artificial Sequence: Synthetic peptide
FDSSGF

SEQ ID NO: 7354 - protein, 6 aa, Artificial Sequence
  Description of Artificial Sequence: Synthetic peptide
VDSSGY

SEQ ID NO: 7355 - protein, 6 aa, Artificial Sequence
  Description of Artificial Sequence: Synthetic peptide
FDSSGS

SEQ ID NO: 7356 - protein, 6 aa, Artificial Sequence
  Description of Artificial Sequence: Synthetic peptide
VDSSGS

SEQ ID NO: 7357 - protein, 6 aa, Artificial Sequence
  Description of Artificial Sequence: Synthetic peptide
YDSSGS

SEQ ID NO: 7358 - protein, 6 aa, Artificial Sequence
  Description of Artificial Sequence: Synthetic peptide
FDSSGY

SEQ ID NO: 7359 - protein, 6 aa, Artificial Sequence
  Description of Artificial Sequence: Synthetic peptide
LDSSGF

SEQ ID NO: 7360 - protein, 6 aa, Artificial Sequence
  Description of Artificial Sequence: Synthetic peptide
HDSSGF

SEQ ID NO: 7361 - protein, 6 aa, Artificial Sequence
  Description of Artificial Sequence: Synthetic peptide
PDSSGF

SEQ ID NO: 7362 - protein, 6 aa, Artificial Sequence
  Description of Artificial Sequence: Synthetic peptide
EYFDWS

SEQ ID NO: 7363 - protein, 6 aa, Artificial Sequence
  Description of Artificial Sequence: Synthetic peptide
QYFDWL

SEQ ID NO: 7364 - protein, 6 aa, Artificial Sequence
  Description of Artificial Sequence: Synthetic peptide
RYFDWF

SEQ ID NO: 7365 - protein, 6 aa, Artificial Sequence
  Description of Artificial Sequence: Synthetic peptide
AYFDWF

SEQ ID NO: 7366 - protein, 6 aa, Artificial Sequence
  Description of Artificial Sequence: Synthetic peptide
PYFDWF

SEQ ID NO: 7367 - protein, 6 aa, Artificial Sequence
  Description of Artificial Sequence: Synthetic peptide
PYFDWP

SEQ ID NO: 7368 - protein, 6 aa, Artificial Sequence
  Description of Artificial Sequence: Synthetic peptide
LYFDWP

SEQ ID NO: 7369 - protein, 6 aa, Artificial Sequence
  Description of Artificial Sequence: Synthetic peptide
EYFDWP

SEQ ID NO: 7370 - protein, 6 aa, Artificial Sequence
  Description of Artificial Sequence: Synthetic peptide
EYFDWL

SEQ ID NO: 7371 - protein, 6 aa, Artificial Sequence
  Description of Artificial Sequence: Synthetic peptide
LYFDWL

SEQ ID NO: 7372 - protein, 6 aa, Artificial Sequence
  Description of Artificial Sequence: Synthetic peptide
PYFDWL

SEQ ID NO: 7373 - protein, 6 aa, Artificial Sequence
  Description of Artificial Sequence: Synthetic peptide
LYFDWS

SEQ ID NO: 7374 - protein, 6 aa, Artificial Sequence
  Description of Artificial Sequence: Synthetic peptide
QYFDWS

SEQ ID NO: 7375 - protein, 6 aa, Artificial Sequence
  Description of Artificial Sequence: Synthetic peptide
QYFDWF

SEQ ID NO: 7376 - protein, 6 aa, Artificial Sequence
  Description of Artificial Sequence: Synthetic peptide
VYFDWF

SEQ ID NO: 7377 - protein, 6 aa, Artificial Sequence
  Description of Artificial Sequence: Synthetic peptide
RYFDWP

SEQ ID NO: 7378 - protein, 6 aa, Artificial Sequence
  Description of Artificial Sequence: Synthetic peptide
AYFDWP

SEQ ID NO: 7379 - protein, 6 aa, Artificial Sequence
  Description of Artificial Sequence: Synthetic peptide
LYFDWF

SEQ ID NO: 7380 - protein, 6 aa, Artificial Sequence
  Description of Artificial Sequence: Synthetic peptide
AYFDWL

SEQ ID NO: 7381 - protein, 6 aa, Artificial Sequence
  Description of Artificial Sequence: Synthetic peptide
GYFDWF

SEQ ID NO: 7382 - protein, 6 aa, Artificial Sequence
  Description of Artificial Sequence: Synthetic peptide
GYFDWS

SEQ ID NO: 7383 - protein, 6 aa, Artificial Sequence
  Description of Artificial Sequence: Synthetic peptide
VYFDWL

SEQ ID NO: 7384 - protein, 6 aa, Artificial Sequence
  Description of Artificial Sequence: Synthetic peptide
VYFDWS

SEQ ID NO: 7385 - protein, 6 aa, Artificial Sequence
  Description of Artificial Sequence: Synthetic peptide
VYFDWP

SEQ ID NO: 7386 - protein, 6 aa, Artificial Sequence
  Description of Artificial Sequence: Synthetic peptide
RYFDWS

SEQ ID NO: 7387 - protein, 6 aa, Artificial Sequence
  Description of Artificial Sequence: Synthetic peptide
PYFDWS

SEQ ID NO: 7388 - protein, 6 aa, Artificial Sequence
  Description of Artificial Sequence: Synthetic peptide
QYFDWP

SEQ ID NO: 7389 - protein, 6 aa, Artificial Sequence
  Description of Artificial Sequence: Synthetic peptide
EYFDWF

SEQ ID NO: 7390 - protein, 6 aa, Artificial Sequence
  Description of Artificial Sequence: Synthetic peptide
AYFDWS

SEQ ID NO: 7391 - protein, 6 aa, Artificial Sequence
  Description of Artificial Sequence: Synthetic peptide
GYFDWL

SEQ ID NO: 7392 - protein, 6 aa, Artificial Sequence
  Description of Artificial Sequence: Synthetic peptide
GYFDWP

SEQ ID NO: 7393 - protein, 6 aa, Artificial Sequence
  Description of Artificial Sequence: Synthetic peptide
CGSTSC

SEQ ID NO: 7394 - protein, 6 aa, Artificial Sequence
  Description of Artificial Sequence: Synthetic peptide
CSGTSC

SEQ ID NO: 7395 - protein, 6 aa, Artificial Sequence
  Description of Artificial Sequence: Synthetic peptide
CGGTSC

SEQ ID NO: 7396 - protein, 6 aa, Artificial Sequence
  Description of Artificial Sequence: Synthetic peptide
PYYGSE

SEQ ID NO: 7397 - protein, 6 aa, Artificial Sequence
  Description of Artificial Sequence: Synthetic peptide
VYYGSE

SEQ ID NO: 7398 - protein, 6 aa, Artificial Sequence
  Description of Artificial Sequence: Synthetic peptide
AYYGSE

SEQ ID NO: 7399 - protein, 6 aa, Artificial Sequence
  Description of Artificial Sequence: Synthetic peptide
NYYGSE

SEQ ID NO: 7400 - protein, 6 aa, Artificial Sequence
  Description of Artificial Sequence: Synthetic peptide
FYYGSE

SEQ ID NO: 7401 - protein, 6 aa, Artificial Sequence
  Description of Artificial Sequence: Synthetic peptide
YYYGSE

SEQ ID NO: 7402 - protein, 6 aa, Artificial Sequence
  Description of Artificial Sequence: Synthetic peptide
DYYGSE

SEQ ID NO: 7403 - protein, 6 aa, Artificial Sequence
  Description of Artificial Sequence: Synthetic peptide
TYYGSE

SEQ ID NO: 7404 - protein, 6 aa, Artificial Sequence
  Description of Artificial Sequence: Synthetic peptide
HYYGSE

SEQ ID NO: 7405 - protein, 6 aa, Artificial Sequence
  Description of Artificial Sequence: Synthetic peptide
LYYGSE

SEQ ID NO: 7406 - protein, 6 aa, Artificial Sequence
  Description of Artificial Sequence: Synthetic peptide
IYYGSE

SEQ ID NO: 7407 - protein, 6 aa, Artificial Sequence
  Description of Artificial Sequence: Synthetic peptide
SYYGSE

SEQ ID NO: 7408 - protein, 6 aa, Artificial Sequence
  Description of Artificial Sequence: Synthetic peptide
CSSGSC

SEQ ID NO: 7409 - protein, 6 aa, Artificial Sequence
  Description of Artificial Sequence: Synthetic peptide
CGGGSC

SEQ ID NO: 7410 - protein, 6 aa, Artificial Sequence
  Description of Artificial Sequence: Synthetic peptide
CGSGSC

SEQ ID NO: 7411 - protein, 6 aa, Artificial Sequence
  Description of Artificial Sequence: Synthetic peptide
PFWSGS

SEQ ID NO: 7412 - protein, 6 aa, Artificial Sequence
  Description of Artificial Sequence: Synthetic peptide
DFWSGF

SEQ ID NO: 7413 - protein, 6 aa, Artificial Sequence
  Description of Artificial Sequence: Synthetic peptide
PFWSGY

SEQ ID NO: 7414 - protein, 6 aa, Artificial Sequence
  Description of Artificial Sequence: Synthetic peptide
AFWSGY

SEQ ID NO: 7415 - protein, 6 aa, Artificial Sequence
  Description of Artificial Sequence: Synthetic peptide
AFWSGS

SEQ ID NO: 7416 - protein, 6 aa, Artificial Sequence
  Description of Artificial Sequence: Synthetic peptide
AFWSGF

SEQ ID NO: 7417 - protein, 6 aa, Artificial Sequence
  Description of Artificial Sequence: Synthetic peptide
PFWSGF

SEQ ID NO: 7418 - protein, 6 aa, Artificial Sequence
  Description of Artificial Sequence: Synthetic peptide
VFWSGY

SEQ ID NO: 7419 - protein, 6 aa, Artificial Sequence
  Description of Artificial Sequence: Synthetic peptide
YFWSGF

SEQ ID NO: 7420 - protein, 6 aa, Artificial Sequence
  Description of Artificial Sequence: Synthetic peptide
IFWSGS

SEQ ID NO: 7421 - protein, 6 aa, Artificial Sequence
  Description of Artificial Sequence: Synthetic peptide
VFWSGF

SEQ ID NO: 7422 - protein, 6 aa, Artificial Sequence
  Description of Artificial Sequence: Synthetic peptide
VFWSGS

SEQ ID NO: 7423 - protein, 6 aa, Artificial Sequence
  Description of Artificial Sequence: Synthetic peptide
IFWSGF

SEQ ID NO: 7424 - protein, 6 aa, Artificial Sequence
  Description of Artificial Sequence: Synthetic peptide
IFWSGY

SEQ ID NO: 7425 - protein, 6 aa, Artificial Sequence
  Description of Artificial Sequence: Synthetic peptide
SFWSGF

SEQ ID NO: 7426 - protein, 6 aa, Artificial Sequence
  Description of Artificial Sequence: Synthetic peptide
YFWSGY

SEQ ID NO: 7427 - protein, 6 aa, Artificial Sequence
  Description of Artificial Sequence: Synthetic peptide
FFWSGS

SEQ ID NO: 7428 - protein, 6 aa, Artificial Sequence
  Description of Artificial Sequence: Synthetic peptide
YFWSGS

SEQ ID NO: 7429 - protein, 6 aa, Artificial Sequence
  Description of Artificial Sequence: Synthetic peptide
FFWSGY

SEQ ID NO: 7430 - protein, 6 aa, Artificial Sequence
  Description of Artificial Sequence: Synthetic peptide
LFWSGF

SEQ ID NO: 7431 - protein, 6 aa, Artificial Sequence
  Description of Artificial Sequence: Synthetic peptide
TFWSGF

SEQ ID NO: 7432 - protein, 6 aa, Artificial Sequence
  Description of Artificial Sequence: Synthetic peptide
NFWSGF

SEQ ID NO: 7433 - protein, 6 aa, Artificial Sequence
  Description of Artificial Sequence: Synthetic peptide
HFWSGF

SEQ ID NO: 7434 - protein, 6 aa, Artificial Sequence
  Description of Artificial Sequence: Synthetic peptide
NFWSGS

SEQ ID NO: 7435 - protein, 6 aa, Artificial Sequence
  Description of Artificial Sequence: Synthetic peptide
SFWSGS

SEQ ID NO: 7436 - protein, 6 aa, Artificial Sequence
  Description of Artificial Sequence: Synthetic peptide
TFWSGS

SEQ ID NO: 7437 - protein, 6 aa, Artificial Sequence
  Description of Artificial Sequence: Synthetic peptide
NFWSGY

SEQ ID NO: 7438 - protein, 6 aa, Artificial Sequence
  Description of Artificial Sequence: Synthetic peptide
LFWSGY

SEQ ID NO: 7439 - protein, 6 aa, Artificial Sequence
  Description of Artificial Sequence: Synthetic peptide
HFWSGS

SEQ ID NO: 7440 - protein, 6 aa, Artificial Sequence
  Description of Artificial Sequence: Synthetic peptide
SFWSGY

SEQ ID NO: 7441 - protein, 6 aa, Artificial Sequence
  Description of Artificial Sequence: Synthetic peptide
TFWSGY

SEQ ID NO: 7442 - protein, 6 aa, Artificial Sequence
  Description of Artificial Sequence: Synthetic peptide
DFWSGS

SEQ ID NO: 7443 - protein, 6 aa, Artificial Sequence
  Description of Artificial Sequence: Synthetic peptide
LFWSGS

SEQ ID NO: 7444 - protein, 6 aa, Artificial Sequence
  Description of Artificial Sequence: Synthetic peptide
HFWSGY

SEQ ID NO: 7445 - protein, 6 aa, Artificial Sequence
  Description of Artificial Sequence: Synthetic peptide
FFWSGF

SEQ ID NO: 7446 - protein, 7 aa, Artificial Sequence
  Description of Artificial Sequence: Synthetic peptide
DYYDSSG

SEQ ID NO: 7447 - protein, 7 aa, Artificial Sequence
  Description of Artificial Sequence: Synthetic peptide
SYYDSSG

SEQ ID NO: 7448 - protein, 7 aa, Artificial Sequence
  Description of Artificial Sequence: Synthetic peptide
IYYDSSG

SEQ ID NO: 7449 - protein, 7 aa, Artificial Sequence
  Description of Artificial Sequence: Synthetic peptide
HYYDSSG

SEQ ID NO: 7450 - protein, 7 aa, Artificial Sequence
  Description of Artificial Sequence: Synthetic peptide
SYYDSSA

SEQ ID NO: 7451 - protein, 7 aa, Artificial Sequence
  Description of Artificial Sequence: Synthetic peptide
SYYDSSD

SEQ ID NO: 7452 - protein, 7 aa, Artificial Sequence
  Description of Artificial Sequence: Synthetic peptide
IYYDSSA

SEQ ID NO: 7453 - protein, 7 aa, Artificial Sequence
  Description of Artificial Sequence: Synthetic peptide
AYYDSSA

SEQ ID NO: 7454 - protein, 7 aa, Artificial Sequence
  Description of Artificial Sequence: Synthetic peptide
IYYDSSD

SEQ ID NO: 7455 - protein, 7 aa, Artificial Sequence
  Description of Artificial Sequence: Synthetic peptide
AYYDSSD

SEQ ID NO: 7456 - protein, 7 aa, Artificial Sequence
  Description of Artificial Sequence: Synthetic peptide
HYYDSSD

SEQ ID NO: 7457 - protein, 7 aa, Artificial Sequence
  Description of Artificial Sequence: Synthetic peptide
VYYDSSD

SEQ ID NO: 7458 - protein, 7 aa, Artificial Sequence
  Description of Artificial Sequence: Synthetic peptide
HYYDSSA

SEQ ID NO: 7459 - protein, 7 aa, Artificial Sequence
  Description of Artificial Sequence: Synthetic peptide
AYYDSSG

SEQ ID NO: 7460 - protein, 7 aa, Artificial Sequence
  Description of Artificial Sequence: Synthetic peptide
VYYDSSA

SEQ ID NO: 7461 - protein, 7 aa, Artificial Sequence
  Description of Artificial Sequence: Synthetic peptide
LYYDSSG

SEQ ID NO: 7462 - protein, 7 aa, Artificial Sequence
  Description of Artificial Sequence: Synthetic peptide
VYYDSSG

SEQ ID NO: 7463 - protein, 7 aa, Artificial Sequence
  Description of Artificial Sequence: Synthetic peptide
LYYDSSD

SEQ ID NO: 7464 - protein, 7 aa, Artificial Sequence
  Description of Artificial Sequence: Synthetic peptide
FYYDSSG

SEQ ID NO: 7465 - protein, 7 aa, Artificial Sequence
  Description of Artificial Sequence: Synthetic peptide
LYYDSSA

SEQ ID NO: 7466 - protein, 7 aa, Artificial Sequence
  Description of Artificial Sequence: Synthetic peptide
FYYDSSD

SEQ ID NO: 7467 - protein, 7 aa, Artificial Sequence
  Description of Artificial Sequence: Synthetic peptide
TYYDSSG

SEQ ID NO: 7468 - protein, 7 aa, Artificial Sequence
  Description of Artificial Sequence: Synthetic peptide
PYYDSSG

SEQ ID NO: 7469 - protein, 7 aa, Artificial Sequence
  Description of Artificial Sequence: Synthetic peptide
FYYDSSA

SEQ ID NO: 7470 - protein, 7 aa, Artificial Sequence
  Description of Artificial Sequence: Synthetic peptide
TYYDSSD

SEQ ID NO: 7471 - protein, 7 aa, Artificial Sequence
  Description of Artificial Sequence: Synthetic peptide
NYYDSSG

SEQ ID NO: 7472 - protein, 7 aa, Artificial Sequence
  Description of Artificial Sequence: Synthetic peptide
TYYDSSA

SEQ ID NO: 7473 - protein, 7 aa, Artificial Sequence
  Description of Artificial Sequence: Synthetic peptide
PYYDSSA

SEQ ID NO: 7474 - protein, 7 aa, Artificial Sequence
  Description of Artificial Sequence: Synthetic peptide
PYYDSSD

SEQ ID NO: 7475 - protein, 7 aa, Artificial Sequence
  Description of Artificial Sequence: Synthetic peptide
NYYDSSA

SEQ ID NO: 7476 - protein, 7 aa, Artificial Sequence
  Description of Artificial Sequence: Synthetic peptide
YYYDSSD

SEQ ID NO: 7477 - protein, 7 aa, Artificial Sequence
  Description of Artificial Sequence: Synthetic peptide
NYYDSSD

SEQ ID NO: 7478 - protein, 7 aa, Artificial Sequence
  Description of Artificial Sequence: Synthetic peptide
YYYDSSA

SEQ ID NO: 7479 - protein, 7 aa, Artificial Sequence
  Description of Artificial Sequence: Synthetic peptide
DYYDSSD

SEQ ID NO: 7480 - protein, 7 aa, Artificial Sequence
  Description of Artificial Sequence: Synthetic peptide
DYYDSSA

SEQ ID NO: 7481 - protein, 7 aa, Artificial Sequence
  Description of Artificial Sequence: Synthetic peptide
FDILTGF

SEQ ID NO: 7482 - protein, 7 aa, Artificial Sequence
  Description of Artificial Sequence: Synthetic peptide
FDILTGS

SEQ ID NO: 7483 - protein, 7 aa, Artificial Sequence
  Description of Artificial Sequence: Synthetic peptide
LDILTGY

SEQ ID NO: 7484 - protein, 7 aa, Artificial Sequence
  Description of Artificial Sequence: Synthetic peptide
YDILTGF

SEQ ID NO: 7485 - protein, 7 aa, Artificial Sequence
  Description of Artificial Sequence: Synthetic peptide
LDILTGS

SEQ ID NO: 7486 - protein, 7 aa, Artificial Sequence
  Description of Artificial Sequence: Synthetic peptide
SDILTGF

SEQ ID NO: 7487 - protein, 7 aa, Artificial Sequence
  Description of Artificial Sequence: Synthetic peptide
IDILTGS

SEQ ID NO: 7488 - protein, 7 aa, Artificial Sequence
  Description of Artificial Sequence: Synthetic peptide
PDILTGS

SEQ ID NO: 7489 - protein, 7 aa, Artificial Sequence
  Description of Artificial Sequence: Synthetic peptide
PDILTGF

SEQ ID NO: 7490 - protein, 7 aa, Artificial Sequence
  Description of Artificial Sequence: Synthetic peptide
IDILTGF

SEQ ID NO: 7491 - protein, 7 aa, Artificial Sequence
  Description of Artificial Sequence: Synthetic peptide
IDILTGY

SEQ ID NO: 7492 - protein, 7 aa, Artificial Sequence
  Description of Artificial Sequence: Synthetic peptide
PDILTGY

SEQ ID NO: 7493 - protein, 7 aa, Artificial Sequence
  Description of Artificial Sequence: Synthetic peptide
DDILTGF

SEQ ID NO: 7494 - protein, 7 aa, Artificial Sequence
  Description of Artificial Sequence: Synthetic peptide
YDILTGS

SEQ ID NO: 7495 - protein, 7 aa, Artificial Sequence
  Description of Artificial Sequence: Synthetic peptide
HDILTGY

SEQ ID NO: 7496 - protein, 7 aa, Artificial Sequence
  Description of Artificial Sequence: Synthetic peptide
TDILTGF

SEQ ID NO: 7497 - protein, 7 aa, Artificial Sequence
  Description of Artificial Sequence: Synthetic peptide
VDILTGY

SEQ ID NO: 7498 - protein, 7 aa, Artificial Sequence
  Description of Artificial Sequence: Synthetic peptide
LDILTGF

SEQ ID NO: 7499 - protein, 7 aa, Artificial Sequence
  Description of Artificial Sequence: Synthetic peptide
VDILTGS

SEQ ID NO: 7500 - protein, 7 aa, Artificial Sequence
  Description of Artificial Sequence: Synthetic peptide
HDILTGS

SEQ ID NO: 7501 - protein, 7 aa, Artificial Sequence
  Description of Artificial Sequence: Synthetic peptide
ADILTGS

SEQ ID NO: 7502 - protein, 7 aa, Artificial Sequence
  Description of Artificial Sequence: Synthetic peptide
HDILTGF

SEQ ID NO: 7503 - protein, 7 aa, Artificial Sequence
  Description of Artificial Sequence: Synthetic peptide
NDILTGS

SEQ ID NO: 7504 - protein, 7 aa, Artificial Sequence
  Description of Artificial Sequence: Synthetic peptide
NDILTGF

SEQ ID NO: 7505 - protein, 7 aa, Artificial Sequence
  Description of Artificial Sequence: Synthetic peptide
ADILTGY

SEQ ID NO: 7506 - protein, 7 aa, Artificial Sequence
  Description of Artificial Sequence: Synthetic peptide
VDILTGF

SEQ ID NO: 7507 - protein, 7 aa, Artificial Sequence
  Description of Artificial Sequence: Synthetic peptide
TDILTGY

SEQ ID NO: 7508 - protein, 7 aa, Artificial Sequence
  Description of Artificial Sequence: Synthetic peptide
ADILTGF

SEQ ID NO: 7509 - protein, 7 aa, Artificial Sequence
  Description of Artificial Sequence: Synthetic peptide
NDILTGY

SEQ ID NO: 7510 - protein, 7 aa, Artificial Sequence
  Description of Artificial Sequence: Synthetic peptide
TDILTGS

SEQ ID NO: 7511 - protein, 7 aa, Artificial Sequence
  Description of Artificial Sequence: Synthetic peptide
SDILTGS

SEQ ID NO: 7512 - protein, 7 aa, Artificial Sequence
  Description of Artificial Sequence: Synthetic peptide
DDILTGY

SEQ ID NO: 7513 - protein, 7 aa, Artificial Sequence
  Description of Artificial Sequence: Synthetic peptide
SDILTGY

SEQ ID NO: 7514 - protein, 7 aa, Artificial Sequence
  Description of Artificial Sequence: Synthetic peptide
DDILTGS

SEQ ID NO: 7515 - protein, 7 aa, Artificial Sequence
  Description of Artificial Sequence: Synthetic peptide
FDILTGY

SEQ ID NO: 7516 - protein, 7 aa, Artificial Sequence
  Description of Artificial Sequence: Synthetic peptide
SYDFWSA

SEQ ID NO: 7517 - protein, 7 aa, Artificial Sequence
  Description of Artificial Sequence: Synthetic peptide
FYDFWSG

SEQ ID NO: 7518 - protein, 7 aa, Artificial Sequence
  Description of Artificial Sequence: Synthetic peptide
IYDFWSD

SEQ ID NO: 7519 - protein, 7 aa, Artificial Sequence
  Description of Artificial Sequence: Synthetic peptide
LYDFWSD

SEQ ID NO: 7520 - protein, 7 aa, Artificial Sequence
  Description of Artificial Sequence: Synthetic peptide
AYDFWSD

SEQ ID NO: 7521 - protein, 7 aa, Artificial Sequence
  Description of Artificial Sequence: Synthetic peptide
IYDFWSA

SEQ ID NO: 7522 - protein, 7 aa, Artificial Sequence
  Description of Artificial Sequence: Synthetic peptide
PYDFWSD

SEQ ID NO: 7523 - protein, 7 aa, Artificial Sequence
  Description of Artificial Sequence: Synthetic peptide
AYDFWSA

SEQ ID NO: 7524 - protein, 7 aa, Artificial Sequence
  Description of Artificial Sequence: Synthetic peptide
SYDFWSG

SEQ ID NO: 7525 - protein, 7 aa, Artificial Sequence
  Description of Artificial Sequence: Synthetic peptide
FYDFWSA

SEQ ID NO: 7526 - protein, 7 aa, Artificial Sequence
  Description of Artificial Sequence: Synthetic peptide
PYDFWSA

SEQ ID NO: 7527 - protein, 7 aa, Artificial Sequence
  Description of Artificial Sequence: Synthetic peptide
FYDFWSD

SEQ ID NO: 7528 - protein, 7 aa, Artificial Sequence
  Description of Artificial Sequence: Synthetic peptide
IYDFWSG

SEQ ID NO: 7529 - protein, 7 aa, Artificial Sequence
  Description of Artificial Sequence: Synthetic peptide
PYDFWSG

SEQ ID NO: 7530 - protein, 7 aa, Artificial Sequence
  Description of Artificial Sequence: Synthetic peptide
YYDFWSA

SEQ ID NO: 7531 - protein, 7 aa, Artificial Sequence
  Description of Artificial Sequence: Synthetic peptide
YYDFWSD

SEQ ID NO: 7532 - protein, 7 aa, Artificial Sequence
  Description of Artificial Sequence: Synthetic peptide
NYDFWSD

SEQ ID NO: 7533 - protein, 7 aa, Artificial Sequence
  Description of Artificial Sequence: Synthetic peptide
VYDFWSA

SEQ ID NO: 7534 - protein, 7 aa, Artificial Sequence
  Description of Artificial Sequence: Synthetic peptide
NYDFWSA

SEQ ID NO: 7535 - protein, 7 aa, Artificial Sequence
  Description of Artificial Sequence: Synthetic peptide
VYDFWSD

SEQ ID NO: 7536 - protein, 7 aa, Artificial Sequence
  Description of Artificial Sequence: Synthetic peptide
VYDFWSG

SEQ ID NO: 7537 - protein, 7 aa, Artificial Sequence
  Description of Artificial Sequence: Synthetic peptide
NYDFWSG

SEQ ID NO: 7538 - protein, 7 aa, Artificial Sequence
  Description of Artificial Sequence: Synthetic peptide
DYDFWSA

SEQ ID NO: 7539 - protein, 7 aa, Artificial Sequence
  Description of Artificial Sequence: Synthetic peptide
DYDFWSD

SEQ ID NO: 7540 - protein, 7 aa, Artificial Sequence
  Description of Artificial Sequence: Synthetic peptide
DYDFWSG

SEQ ID NO: 7541 - protein, 7 aa, Artificial Sequence
  Description of Artificial Sequence: Synthetic peptide
HYDFWSG

SEQ ID NO: 7542 - protein, 7 aa, Artificial Sequence
  Description of Artificial Sequence: Synthetic peptide
TYDFWSG

SEQ ID NO: 7543 - protein, 7 aa, Artificial Sequence
  Description of Artificial Sequence: Synthetic peptide
HYDFWSA

SEQ ID NO: 7544 - protein, 7 aa, Artificial Sequence
  Description of Artificial Sequence: Synthetic peptide
LYDFWSG

SEQ ID NO: 7545 - protein, 7 aa, Artificial Sequence
  Description of Artificial Sequence: Synthetic peptide
HYDFWSD

SEQ ID NO: 7546 - protein, 7 aa, Artificial Sequence
  Description of Artificial Sequence: Synthetic peptide
TYDFWSA

SEQ ID NO: 7547 - protein, 7 aa, Artificial Sequence
  Description of Artificial Sequence: Synthetic peptide
SYDFWSD

SEQ ID NO: 7548 - protein, 7 aa, Artificial Sequence
  Description of Artificial Sequence: Synthetic peptide
TYDFWSD

SEQ ID NO: 7549 - protein, 7 aa, Artificial Sequence
  Description of Artificial Sequence: Synthetic peptide
LYDFWSA

SEQ ID NO: 7550 - protein, 7 aa, Artificial Sequence
  Description of Artificial Sequence: Synthetic peptide
AYDFWSG

SEQ ID NO: 7551 - protein, 7 aa, Artificial Sequence
  Description of Artificial Sequence: Synthetic peptide
SCSSTSC

SEQ ID NO: 7552 - protein, 7 aa, Artificial Sequence
  Description of Artificial Sequence: Synthetic peptide
HCSSTSC

SEQ ID NO: 7553 - protein, 7 aa, Artificial Sequence
  Description of Artificial Sequence: Synthetic peptide
PCSSTSC

SEQ ID NO: 7554 - protein, 7 aa, Artificial Sequence
  Description of Artificial Sequence: Synthetic peptide
ACSSTSC

SEQ ID NO: 7555 - protein, 7 aa, Artificial Sequence
  Description of Artificial Sequence: Synthetic peptide
VCSSTSC

SEQ ID NO: 7556 - protein, 7 aa, Artificial Sequence
  Description of Artificial Sequence: Synthetic peptide
LCSSTSC

SEQ ID NO: 7557 - protein, 7 aa, Artificial Sequence
  Description of Artificial Sequence: Synthetic peptide
FCSSTSC

SEQ ID NO: 7558 - protein, 7 aa, Artificial Sequence
  Description of Artificial Sequence: Synthetic peptide
DCSSTSC

SEQ ID NO: 7559 - protein, 7 aa, Artificial Sequence
  Description of Artificial Sequence: Synthetic peptide
RYSSSWS

SEQ ID NO: 7560 - protein, 7 aa, Artificial Sequence
  Description of Artificial Sequence: Synthetic peptide
VYSSSWY

SEQ ID NO: 7561 - protein, 7 aa, Artificial Sequence
  Description of Artificial Sequence: Synthetic peptide
VYSSSWS

SEQ ID NO: 7562 - protein, 7 aa, Artificial Sequence
  Description of Artificial Sequence: Synthetic peptide
TYSSSWY

SEQ ID NO: 7563 - protein, 7 aa, Artificial Sequence
  Description of Artificial Sequence: Synthetic peptide
TYSSSWF

SEQ ID NO: 7564 - protein, 7 aa, Artificial Sequence
  Description of Artificial Sequence: Synthetic peptide
TYSSSWS

SEQ ID NO: 7565 - protein, 7 aa, Artificial Sequence
  Description of Artificial Sequence: Synthetic peptide
GYSSSWF

SEQ ID NO: 7566 - protein, 7 aa, Artificial Sequence
  Description of Artificial Sequence: Synthetic peptide
LYSSSWF

SEQ ID NO: 7567 - protein, 7 aa, Artificial Sequence
  Description of Artificial Sequence: Synthetic peptide
AYSSSWS

SEQ ID NO: 7568 - protein, 7 aa, Artificial Sequence
  Description of Artificial Sequence: Synthetic peptide
SYSSSWF

SEQ ID NO: 7569 - protein, 7 aa, Artificial Sequence
  Description of Artificial Sequence: Synthetic peptide
WYSSSWS

SEQ ID NO: 7570 - protein, 7 aa, Artificial Sequence
  Description of Artificial Sequence: Synthetic peptide
WYSSSWF

SEQ ID NO: 7571 - protein, 7 aa, Artificial Sequence
  Description of Artificial Sequence: Synthetic peptide
MYSSSWS

SEQ ID NO: 7572 - protein, 7 aa, Artificial Sequence
  Description of Artificial Sequence: Synthetic peptide
SYSSSWS

SEQ ID NO: 7573 - protein, 7 aa, Artificial Sequence
  Description of Artificial Sequence: Synthetic peptide
LYSSSWY

SEQ ID NO: 7574 - protein, 7 aa, Artificial Sequence
  Description of Artificial Sequence: Synthetic peptide
AYSSSWY

SEQ ID NO: 7575 - protein, 7 aa, Artificial Sequence
  Description of Artificial Sequence: Synthetic peptide
AYSSSWF

SEQ ID NO: 7576 - protein, 7 aa, Artificial Sequence
  Description of Artificial Sequence: Synthetic peptide
LYSSSWS

SEQ ID NO: 7577 - protein, 7 aa, Artificial Sequence
  Description of Artificial Sequence: Synthetic peptide
WYSSSWY

SEQ ID NO: 7578 - protein, 7 aa, Artificial Sequence
  Description of Artificial Sequence: Synthetic peptide
VYSSSWF

SEQ ID NO: 7579 - protein, 7 aa, Artificial Sequence
  Description of Artificial Sequence: Synthetic peptide
SYSSSWY

SEQ ID NO: 7580 - protein, 7 aa, Artificial Sequence
  Description of Artificial Sequence: Synthetic peptide
RYSSSWF

SEQ ID NO: 7581 - protein, 7 aa, Artificial Sequence
  Description of Artificial Sequence: Synthetic peptide
MYSSSWF

SEQ ID NO: 7582 - protein, 7 aa, Artificial Sequence
  Description of Artificial Sequence: Synthetic peptide
RYSSSWY

SEQ ID NO: 7583 - protein, 7 aa, Artificial Sequence
  Description of Artificial Sequence: Synthetic peptide
MYSSSWY

SEQ ID NO: 7584 - protein, 7 aa, Artificial Sequence
  Description of Artificial Sequence: Synthetic peptide
GYSSSWS

SEQ ID NO: 7585 - protein, 7 aa, Artificial Sequence
  Description of Artificial Sequence: Synthetic peptide
IYDSSGY

SEQ ID NO: 7586 - protein, 7 aa, Artificial Sequence
  Description of Artificial Sequence: Synthetic peptide
PYDSSGS

SEQ ID NO: 7587 - protein, 7 aa, Artificial Sequence
  Description of Artificial Sequence: Synthetic peptide
VYDSSGF

SEQ ID NO: 7588 - protein, 7 aa, Artificial Sequence
  Description of Artificial Sequence: Synthetic peptide
PYDSSGY

SEQ ID NO: 7589 - protein, 7 aa, Artificial Sequence
  Description of Artificial Sequence: Synthetic peptide
NYDSSGS

SEQ ID NO: 7590 - protein, 7 aa, Artificial Sequence
  Description of Artificial Sequence: Synthetic peptide
LYDSSGY

SEQ ID NO: 7591 - protein, 7 aa, Artificial Sequence
  Description of Artificial Sequence: Synthetic peptide
NYDSSGY

SEQ ID NO: 7592 - protein, 7 aa, Artificial Sequence
  Description of Artificial Sequence: Synthetic peptide
LYDSSGS

SEQ ID NO: 7593 - protein, 7 aa, Artificial Sequence
  Description of Artificial Sequence: Synthetic peptide
VYDSSGY

SEQ ID NO: 7594 - protein, 7 aa, Artificial Sequence
  Description of Artificial Sequence: Synthetic peptide
VYDSSGS

SEQ ID NO: 7595 - protein, 7 aa, Artificial Sequence
  Description of Artificial Sequence: Synthetic peptide
LYDSSGF

SEQ ID NO: 7596 - protein, 7 aa, Artificial Sequence
  Description of Artificial Sequence: Synthetic peptide
NYDSSGF

SEQ ID NO: 7597 - protein, 7 aa, Artificial Sequence
  Description of Artificial Sequence: Synthetic peptide
YYDSSGS

SEQ ID NO: 7598 - protein, 7 aa, Artificial Sequence
  Description of Artificial Sequence: Synthetic peptide
DYDSSGS

SEQ ID NO: 7599 - protein, 7 aa, Artificial Sequence
  Description of Artificial Sequence: Synthetic peptide
TYDSSGY

SEQ ID NO: 7600 - protein, 7 aa, Artificial Sequence
  Description of Artificial Sequence: Synthetic peptide
TYDSSGF

SEQ ID NO: 7601 - protein, 7 aa, Artificial Sequence
  Description of Artificial Sequence: Synthetic peptide
TYDSSGS

SEQ ID NO: 7602 - protein, 7 aa, Artificial Sequence
  Description of Artificial Sequence: Synthetic peptide
YYDSSGF

SEQ ID NO: 7603 - protein, 7 aa, Artificial Sequence
  Description of Artificial Sequence: Synthetic peptide
AYDSSGS

SEQ ID NO: 7604 - protein, 7 aa, Artificial Sequence
  Description of Artificial Sequence: Synthetic peptide
HYDSSGY

SEQ ID NO: 7605 - protein, 7 aa, Artificial Sequence
  Description of Artificial Sequence: Synthetic peptide
AYDSSGY

SEQ ID NO: 7606 - protein, 7 aa, Artificial Sequence
  Description of Artificial Sequence: Synthetic peptide
HYDSSGF

SEQ ID NO: 7607 - protein, 7 aa, Artificial Sequence
  Description of Artificial Sequence: Synthetic peptide
HYDSSGS

SEQ ID NO: 7608 - protein, 7 aa, Artificial Sequence
  Description of Artificial Sequence: Synthetic peptide
FYDSSGF

SEQ ID NO: 7609 - protein, 7 aa, Artificial Sequence
  Description of Artificial Sequence: Synthetic peptide
IYDSSGF

SEQ ID NO: 7610 - protein, 7 aa, Artificial Sequence
  Description of Artificial Sequence: Synthetic peptide
DYDSSGY

SEQ ID NO: 7611 - protein, 7 aa, Artificial Sequence
  Description of Artificial Sequence: Synthetic peptide
DYDSSGF

SEQ ID NO: 7612 - protein, 7 aa, Artificial Sequence
  Description of Artificial Sequence: Synthetic peptide
PYDSSGF

SEQ ID NO: 7613 - protein, 7 aa, Artificial Sequence
  Description of Artificial Sequence: Synthetic peptide
SYDSSGS

SEQ ID NO: 7614 - protein, 7 aa, Artificial Sequence
  Description of Artificial Sequence: Synthetic peptide
SYDSSGF

SEQ ID NO: 7615 - protein, 7 aa, Artificial Sequence
  Description of Artificial Sequence: Synthetic peptide
AYDSSGF

SEQ ID NO: 7616 - protein, 7 aa, Artificial Sequence
  Description of Artificial Sequence: Synthetic peptide
FYDSSGY

SEQ ID NO: 7617 - protein, 7 aa, Artificial Sequence
  Description of Artificial Sequence: Synthetic peptide
SYDSSGY

SEQ ID NO: 7618 - protein, 7 aa, Artificial Sequence
  Description of Artificial Sequence: Synthetic peptide
IYDSSGS

SEQ ID NO: 7619 - protein, 7 aa, Artificial Sequence
  Description of Artificial Sequence: Synthetic peptide
FYDSSGS

SEQ ID NO: 7620 - protein, 7 aa, Artificial Sequence
  Description of Artificial Sequence: Synthetic peptide
HYYGSGI

SEQ ID NO: 7621 - protein, 7 aa, Artificial Sequence
  Description of Artificial Sequence: Synthetic peptide
SYYGSGI

SEQ ID NO: 7622 - protein, 7 aa, Artificial Sequence
  Description of Artificial Sequence: Synthetic peptide
AYYGSGT

SEQ ID NO: 7623 - protein, 7 aa, Artificial Sequence
  Description of Artificial Sequence: Synthetic peptide
DYYGSGI

SEQ ID NO: 7624 - protein, 7 aa, Artificial Sequence
  Description of Artificial Sequence: Synthetic peptide
VYYGSGT

SEQ ID NO: 7625 - protein, 7 aa, Artificial Sequence
  Description of Artificial Sequence: Synthetic peptide
AYYGSGS

SEQ ID NO: 7626 - protein, 7 aa, Artificial Sequence
  Description of Artificial Sequence: Synthetic peptide
VYYGSGI

SEQ ID NO: 7627 - protein, 7 aa, Artificial Sequence
  Description of Artificial Sequence: Synthetic peptide
VYYGSGS

SEQ ID NO: 7628 - protein, 7 aa, Artificial Sequence
  Description of Artificial Sequence: Synthetic peptide
HYYGSGS

SEQ ID NO: 7629 - protein, 7 aa, Artificial Sequence
  Description of Artificial Sequence: Synthetic peptide
LYYGSGS

SEQ ID NO: 7630 - protein, 7 aa, Artificial Sequence
  Description of Artificial Sequence: Synthetic peptide
HYYGSGT

SEQ ID NO: 7631 - protein, 7 aa, Artificial Sequence
  Description of Artificial Sequence: Synthetic peptide
LYYGSGT

SEQ ID NO: 7632 - protein, 7 aa, Artificial Sequence
  Description of Artificial Sequence: Synthetic peptide
PYYGSGS

SEQ ID NO: 7633 - protein, 7 aa, Artificial Sequence
  Description of Artificial Sequence: Synthetic peptide
SYYGSGS

SEQ ID NO: 7634 - protein, 7 aa, Artificial Sequence
  Description of Artificial Sequence: Synthetic peptide
NYYGSGS

SEQ ID NO: 7635 - protein, 7 aa, Artificial Sequence
  Description of Artificial Sequence: Synthetic peptide
IYYGSGS

SEQ ID NO: 7636 - protein, 7 aa, Artificial Sequence
  Description of Artificial Sequence: Synthetic peptide
DYYGSGT

SEQ ID NO: 7637 - protein, 7 aa, Artificial Sequence
  Description of Artificial Sequence: Synthetic peptide
PYYGSGI

SEQ ID NO: 7638 - protein, 7 aa, Artificial Sequence
  Description of Artificial Sequence: Synthetic peptide
PYYGSGT

SEQ ID NO: 7639 - protein, 7 aa, Artificial Sequence
  Description of Artificial Sequence: Synthetic peptide
SYYGSGT

SEQ ID NO: 7640 - protein, 7 aa, Artificial Sequence
  Description of Artificial Sequence: Synthetic peptide
FYYGSGS

SEQ ID NO: 7641 - protein, 7 aa, Artificial Sequence
  Description of Artificial Sequence: Synthetic peptide
NYYGSGT

SEQ ID NO: 7642 - protein, 7 aa, Artificial Sequence
  Description of Artificial Sequence: Synthetic peptide
IYYGSGT

SEQ ID NO: 7643 - protein, 7 aa, Artificial Sequence
  Description of Artificial Sequence: Synthetic peptide
DYYGSGS

SEQ ID NO: 7644 - protein, 7 aa, Artificial Sequence
  Description of Artificial Sequence: Synthetic peptide
TYYGSGS

SEQ ID NO: 7645 - protein, 7 aa, Artificial Sequence
  Description of Artificial Sequence: Synthetic peptide
FYYGSGT

SEQ ID NO: 7646 - protein, 7 aa, Artificial Sequence
  Description of Artificial Sequence: Synthetic peptide
YYYGSGT

SEQ ID NO: 7647 - protein, 7 aa, Artificial Sequence
  Description of Artificial Sequence: Synthetic peptide
TYYGSGT

SEQ ID NO: 7648 - protein, 7 aa, Artificial Sequence
  Description of Artificial Sequence: Synthetic peptide
YYYGSGI

SEQ ID NO: 7649 - protein, 7 aa, Artificial Sequence
  Description of Artificial Sequence: Synthetic peptide
FYYGSGI

SEQ ID NO: 7650 - protein, 7 aa, Artificial Sequence
  Description of Artificial Sequence: Synthetic peptide
AYYGSGI

SEQ ID NO: 7651 - protein, 7 aa, Artificial Sequence
  Description of Artificial Sequence: Synthetic peptide
TYYGSGI

SEQ ID NO: 7652 - protein, 7 aa, Artificial Sequence
  Description of Artificial Sequence: Synthetic peptide
IYYGSGI

SEQ ID NO: 7653 - protein, 7 aa, Artificial Sequence
  Description of Artificial Sequence: Synthetic peptide
LYYGSGI

SEQ ID NO: 7654 - protein, 7 aa, Artificial Sequence
  Description of Artificial Sequence: Synthetic peptide
NYYGSGI

SEQ ID NO: 7655 - protein, 7 aa, Artificial Sequence
  Description of Artificial Sequence: Synthetic peptide
TYSSGWF

SEQ ID NO: 7656 - protein, 7 aa, Artificial Sequence
  Description of Artificial Sequence: Synthetic peptide
TYSSGWS

SEQ ID NO: 7657 - protein, 7 aa, Artificial Sequence
  Description of Artificial Sequence: Synthetic peptide
VYSSGWF

SEQ ID NO: 7658 - protein, 7 aa, Artificial Sequence
  Description of Artificial Sequence: Synthetic peptide
GYSSGWF

SEQ ID NO: 7659 - protein, 7 aa, Artificial Sequence
  Description of Artificial Sequence: Synthetic peptide
MYSSGWS

SEQ ID NO: 7660 - protein, 7 aa, Artificial Sequence
  Description of Artificial Sequence: Synthetic peptide
SYSSGWF

SEQ ID NO: 7661 - protein, 7 aa, Artificial Sequence
  Description of Artificial Sequence: Synthetic peptide
MYSSGWY

SEQ ID NO: 7662 - protein, 7 aa, Artificial Sequence
  Description of Artificial Sequence: Synthetic peptide
LYSSGWY

SEQ ID NO: 7663 - protein, 7 aa, Artificial Sequence
  Description of Artificial Sequence: Synthetic peptide
MYSSGWF

SEQ ID NO: 7664 - protein, 7 aa, Artificial Sequence
  Description of Artificial Sequence: Synthetic peptide
WYSSGWS

SEQ ID NO: 7665 - protein, 7 aa, Artificial Sequence
  Description of Artificial Sequence: Synthetic peptide
WYSSGWY

SEQ ID NO: 7666 - protein, 7 aa, Artificial Sequence
  Description of Artificial Sequence: Synthetic peptide
AYSSGWS

SEQ ID NO: 7667 - protein, 7 aa, Artificial Sequence
  Description of Artificial Sequence: Synthetic peptide
RYSSGWF

SEQ ID NO: 7668 - protein, 7 aa, Artificial Sequence
  Description of Artificial Sequence: Synthetic peptide
LYSSGWF

SEQ ID NO: 7669 - protein, 7 aa, Artificial Sequence
  Description of Artificial Sequence: Synthetic peptide
AYSSGWY

SEQ ID NO: 7670 - protein, 7 aa, Artificial Sequence
  Description of Artificial Sequence: Synthetic peptide
RYSSGWY

SEQ ID NO: 7671 - protein, 7 aa, Artificial Sequence
  Description of Artificial Sequence: Synthetic peptide
SYSSGWY

SEQ ID NO: 7672 - protein, 7 aa, Artificial Sequence
  Description of Artificial Sequence: Synthetic peptide
RYSSGWS

SEQ ID NO: 7673 - protein, 7 aa, Artificial Sequence
  Description of Artificial Sequence: Synthetic peptide
WYSSGWF

SEQ ID NO: 7674 - protein, 7 aa, Artificial Sequence
  Description of Artificial Sequence: Synthetic peptide
AYSSGWF

SEQ ID NO: 7675 - protein, 7 aa, Artificial Sequence
  Description of Artificial Sequence: Synthetic peptide
GYSSGWS

SEQ ID NO: 7676 - protein, 7 aa, Artificial Sequence
  Description of Artificial Sequence: Synthetic peptide
VYSSGWY

SEQ ID NO: 7677 - protein, 7 aa, Artificial Sequence
  Description of Artificial Sequence: Synthetic peptide
VYSSGWS

SEQ ID NO: 7678 - protein, 7 aa, Artificial Sequence
  Description of Artificial Sequence: Synthetic peptide
LYSSGWS

SEQ ID NO: 7679 - protein, 7 aa, Artificial Sequence
  Description of Artificial Sequence: Synthetic peptide
TYSSGWY

SEQ ID NO: 7680 - protein, 7 aa, Artificial Sequence
  Description of Artificial Sequence: Synthetic peptide
SYSSGWS

SEQ ID NO: 7681 - protein, 7 aa, Artificial Sequence
  Description of Artificial Sequence: Synthetic peptide
FCSGGSC

SEQ ID NO: 7682 - protein, 7 aa, Artificial Sequence
  Description of Artificial Sequence: Synthetic peptide
LCSGGSC

SEQ ID NO: 7683 - protein, 7 aa, Artificial Sequence
  Description of Artificial Sequence: Synthetic peptide
SCSGGSC

SEQ ID NO: 7684 - protein, 7 aa, Artificial Sequence
  Description of Artificial Sequence: Synthetic peptide
DCSGGSC

SEQ ID NO: 7685 - protein, 7 aa, Artificial Sequence
  Description of Artificial Sequence: Synthetic peptide
HCSGGSC

SEQ ID NO: 7686 - protein, 7 aa, Artificial Sequence
  Description of Artificial Sequence: Synthetic peptide
PCSGGSC

SEQ ID NO: 7687 - protein, 7 aa, Artificial Sequence
  Description of Artificial Sequence: Synthetic peptide
ACSGGSC

SEQ ID NO: 7688 - protein, 7 aa, Artificial Sequence
  Description of Artificial Sequence: Synthetic peptide
VCSGGSC

SEQ ID NO: 7689 - protein, 7 aa, Artificial Sequence
  Description of Artificial Sequence: Synthetic peptide
CSGGSCH

SEQ ID NO: 7690 - protein, 7 aa, Artificial Sequence
  Description of Artificial Sequence: Synthetic peptide
CSGGSCL

SEQ ID NO: 7691 - protein, 7 aa, Artificial Sequence
  Description of Artificial Sequence: Synthetic peptide
CSGGSCS

SEQ ID NO: 7692 - protein, 7 aa, Artificial Sequence
  Description of Artificial Sequence: Synthetic peptide
CSGGSCP

SEQ ID NO: 7693 - protein, 7 aa, Artificial Sequence
  Description of Artificial Sequence: Synthetic peptide
CSGGSCF

SEQ ID NO: 7694 - protein, 7 aa, Artificial Sequence
  Description of Artificial Sequence: Synthetic peptide
CSSTSCL

SEQ ID NO: 7695 - protein, 7 aa, Artificial Sequence
  Description of Artificial Sequence: Synthetic peptide
CSSTSCF

SEQ ID NO: 7696 - protein, 7 aa, Artificial Sequence
  Description of Artificial Sequence: Synthetic peptide
CSSTSCH

SEQ ID NO: 7697 - protein, 7 aa, Artificial Sequence
  Description of Artificial Sequence: Synthetic peptide
CSSTSCS

SEQ ID NO: 7698 - protein, 7 aa, Artificial Sequence
  Description of Artificial Sequence: Synthetic peptide
CSSTSCP

SEQ ID NO: 7699 - protein, 7 aa, Artificial Sequence
  Description of Artificial Sequence: Synthetic peptide
ICGGDCF

SEQ ID NO: 7700 - protein, 7 aa, Artificial Sequence
  Description of Artificial Sequence: Synthetic peptide
VCGGDCS

SEQ ID NO: 7701 - protein, 7 aa, Artificial Sequence
  Description of Artificial Sequence: Synthetic peptide
DCGGDCF

SEQ ID NO: 7702 - protein, 7 aa, Artificial Sequence
  Description of Artificial Sequence: Synthetic peptide
SCGGDCF

SEQ ID NO: 7703 - protein, 7 aa, Artificial Sequence
  Description of Artificial Sequence: Synthetic peptide
NCGGDCY

SEQ ID NO: 7704 - protein, 7 aa, Artificial Sequence
  Description of Artificial Sequence: Synthetic peptide
VCGGDCY

SEQ ID NO: 7705 - protein, 7 aa, Artificial Sequence
  Description of Artificial Sequence: Synthetic peptide
SCGGDCS

SEQ ID NO: 7706 - protein, 7 aa, Artificial Sequence
  Description of Artificial Sequence: Synthetic peptide
NCGGDCS

SEQ ID NO: 7707 - protein, 7 aa, Artificial Sequence
  Description of Artificial Sequence: Synthetic peptide
HCGGDCF

SEQ ID NO: 7708 - protein, 7 aa, Artificial Sequence
  Description of Artificial Sequence: Synthetic peptide
LCGGDCS

SEQ ID NO: 7709 - protein, 7 aa, Artificial Sequence
  Description of Artificial Sequence: Synthetic peptide
LCGGDCY

SEQ ID NO: 7710 - protein, 7 aa, Artificial Sequence
  Description of Artificial Sequence: Synthetic peptide
ICGGDCY

SEQ ID NO: 7711 - protein, 7 aa, Artificial Sequence
  Description of Artificial Sequence: Synthetic peptide
LCGGDCF

SEQ ID NO: 7712 - protein, 7 aa, Artificial Sequence
  Description of Artificial Sequence: Synthetic peptide
ICGGDCS

SEQ ID NO: 7713 - protein, 7 aa, Artificial Sequence
  Description of Artificial Sequence: Synthetic peptide
VCGGDCF

SEQ ID NO: 7714 - protein, 7 aa, Artificial Sequence
  Description of Artificial Sequence: Synthetic peptide
HCGGDCS

SEQ ID NO: 7715 - protein, 7 aa, Artificial Sequence
  Description of Artificial Sequence: Synthetic peptide
YCGGDCF

SEQ ID NO: 7716 - protein, 7 aa, Artificial Sequence
  Description of Artificial Sequence: Synthetic peptide
HCGGDCY

SEQ ID NO: 7717 - protein, 7 aa, Artificial Sequence
  Description of Artificial Sequence: Synthetic peptide
FCGGDCF

SEQ ID NO: 7718 - protein, 7 aa, Artificial Sequence
  Description of Artificial Sequence: Synthetic peptide
YCGGDCS

SEQ ID NO: 7719 - protein, 7 aa, Artificial Sequence
  Description of Artificial Sequence: Synthetic peptide
DCGGDCS

SEQ ID NO: 7720 - protein, 7 aa, Artificial Sequence
  Description of Artificial Sequence: Synthetic peptide
DCGGDCY

SEQ ID NO: 7721 - protein, 7 aa, Artificial Sequence
  Description of Artificial Sequence: Synthetic peptide
PCGGDCF

SEQ ID NO: 7722 - protein, 7 aa, Artificial Sequence
  Description of Artificial Sequence: Synthetic peptide
FCGGDCS

SEQ ID NO: 7723 - protein, 7 aa, Artificial Sequence
  Description of Artificial Sequence: Synthetic peptide
FCGGDCY

SEQ ID NO: 7724 - protein, 7 aa, Artificial Sequence
  Description of Artificial Sequence: Synthetic peptide
ACGGDCF

SEQ ID NO: 7725 - protein, 7 aa, Artificial Sequence
  Description of Artificial Sequence: Synthetic peptide
ACGGDCY

SEQ ID NO: 7726 - protein, 7 aa, Artificial Sequence
  Description of Artificial Sequence: Synthetic peptide
ACGGDCS

SEQ ID NO: 7727 - protein, 7 aa, Artificial Sequence
  Description of Artificial Sequence: Synthetic peptide
PCGGDCY

SEQ ID NO: 7728 - protein, 7 aa, Artificial Sequence
  Description of Artificial Sequence: Synthetic peptide
PCGGDCS

SEQ ID NO: 7729 - protein, 7 aa, Artificial Sequence
  Description of Artificial Sequence: Synthetic peptide
SCGGDCY

SEQ ID NO: 7730 - protein, 7 aa, Artificial Sequence
  Description of Artificial Sequence: Synthetic peptide
NCGGDCF

SEQ ID NO: 7731 - protein, 7 aa, Artificial Sequence
  Description of Artificial Sequence: Synthetic peptide
TCGGDCS

SEQ ID NO: 7732 - protein, 7 aa, Artificial Sequence
  Description of Artificial Sequence: Synthetic peptide
TCGGDCY

SEQ ID NO: 7733 - protein, 7 aa, Artificial Sequence
  Description of Artificial Sequence: Synthetic peptide
TCGGDCF

SEQ ID NO: 7734 - protein, 7 aa, Artificial Sequence
  Description of Artificial Sequence: Synthetic peptide
NDFWSGF

SEQ ID NO: 7735 - protein, 7 aa, Artificial Sequence
  Description of Artificial Sequence: Synthetic peptide
HDFWSGF

SEQ ID NO: 7736 - protein, 7 aa, Artificial Sequence
  Description of Artificial Sequence: Synthetic peptide
SDFWSGF

SEQ ID NO: 7737 - protein, 7 aa, Artificial Sequence
  Description of Artificial Sequence: Synthetic peptide
NDFWSGY

SEQ ID NO: 7738 - protein, 7 aa, Artificial Sequence
  Description of Artificial Sequence: Synthetic peptide
HDFWSGS

SEQ ID NO: 7739 - protein, 7 aa, Artificial Sequence
  Description of Artificial Sequence: Synthetic peptide
DDFWSGF

SEQ ID NO: 7740 - protein, 7 aa, Artificial Sequence
  Description of Artificial Sequence: Synthetic peptide
HDFWSGY

SEQ ID NO: 7741 - protein, 7 aa, Artificial Sequence
  Description of Artificial Sequence: Synthetic peptide
SDFWSGY

SEQ ID NO: 7742 - protein, 7 aa, Artificial Sequence
  Description of Artificial Sequence: Synthetic peptide
FDFWSGF

SEQ ID NO: 7743 - protein, 7 aa, Artificial Sequence
  Description of Artificial Sequence: Synthetic peptide
PDFWSGY

SEQ ID NO: 7744 - protein, 7 aa, Artificial Sequence
  Description of Artificial Sequence: Synthetic peptide
IDFWSGF

SEQ ID NO: 7745 - protein, 7 aa, Artificial Sequence
  Description of Artificial Sequence: Synthetic peptide
SDFWSGS

SEQ ID NO: 7746 - protein, 7 aa, Artificial Sequence
  Description of Artificial Sequence: Synthetic peptide
PDFWSGS

SEQ ID NO: 7747 - protein, 7 aa, Artificial Sequence
  Description of Artificial Sequence: Synthetic peptide
TDFWSGF

SEQ ID NO: 7748 - protein, 7 aa, Artificial Sequence
  Description of Artificial Sequence: Synthetic peptide
LDFWSGS

SEQ ID NO: 7749 - protein, 7 aa, Artificial Sequence
  Description of Artificial Sequence: Synthetic peptide
DDFWSGY

SEQ ID NO: 7750 - protein, 7 aa, Artificial Sequence
  Description of Artificial Sequence: Synthetic peptide
LDFWSGY

SEQ ID NO: 7751 - protein, 7 aa, Artificial Sequence
  Description of Artificial Sequence: Synthetic peptide
FDFWSGS

SEQ ID NO: 7752 - protein, 7 aa, Artificial Sequence
  Description of Artificial Sequence: Synthetic peptide
ADFWSGF

SEQ ID NO: 7753 - protein, 7 aa, Artificial Sequence
  Description of Artificial Sequence: Synthetic peptide
FDFWSGY

SEQ ID NO: 7754 - protein, 7 aa, Artificial Sequence
  Description of Artificial Sequence: Synthetic peptide
TDFWSGS

SEQ ID NO: 7755 - protein, 7 aa, Artificial Sequence
  Description of Artificial Sequence: Synthetic peptide
PDFWSGF

SEQ ID NO: 7756 - protein, 7 aa, Artificial Sequence
  Description of Artificial Sequence: Synthetic peptide
VDFWSGF

SEQ ID NO: 7757 - protein, 7 aa, Artificial Sequence
  Description of Artificial Sequence: Synthetic peptide
TDFWSGY

SEQ ID NO: 7758 - protein, 7 aa, Artificial Sequence
  Description of Artificial Sequence: Synthetic peptide
IDFWSGY

SEQ ID NO: 7759 - protein, 7 aa, Artificial Sequence
  Description of Artificial Sequence: Synthetic peptide
DDFWSGS

SEQ ID NO: 7760 - protein, 7 aa, Artificial Sequence
  Description of Artificial Sequence: Synthetic peptide
YDFWSGS

SEQ ID NO: 7761 - protein, 7 aa, Artificial Sequence
  Description of Artificial Sequence: Synthetic peptide
YDFWSGF

SEQ ID NO: 7762 - protein, 7 aa, Artificial Sequence
  Description of Artificial Sequence: Synthetic peptide
IDFWSGS

SEQ ID NO: 7763 - protein, 7 aa, Artificial Sequence
  Description of Artificial Sequence: Synthetic peptide
NDFWSGS

SEQ ID NO: 7764 - protein, 7 aa, Artificial Sequence
  Description of Artificial Sequence: Synthetic peptide
LDFWSGF

SEQ ID NO: 7765 - protein, 7 aa, Artificial Sequence
  Description of Artificial Sequence: Synthetic peptide
ADFWSGY

SEQ ID NO: 7766 - protein, 7 aa, Artificial Sequence
  Description of Artificial Sequence: Synthetic peptide
VDFWSGS

SEQ ID NO: 7767 - protein, 7 aa, Artificial Sequence
  Description of Artificial Sequence: Synthetic peptide
ADFWSGS

SEQ ID NO: 7768 - protein, 7 aa, Artificial Sequence
  Description of Artificial Sequence: Synthetic peptide
VDFWSGY

SEQ ID NO: 7769 - protein, 7 aa, Artificial Sequence
  Description of Artificial Sequence: Synthetic peptide
YDSSGYS

SEQ ID NO: 7770 - protein, 7 aa, Artificial Sequence
  Description of Artificial Sequence: Synthetic peptide
VDSSGYF

SEQ ID NO: 7771 - protein, 7 aa, Artificial Sequence
  Description of Artificial Sequence: Synthetic peptide
VDSSGYS

SEQ ID NO: 7772 - protein, 7 aa, Artificial Sequence
  Description of Artificial Sequence: Synthetic peptide
ADSSGYS

SEQ ID NO: 7773 - protein, 7 aa, Artificial Sequence
  Description of Artificial Sequence: Synthetic peptide
HDSSGYF

SEQ ID NO: 7774 - protein, 7 aa, Artificial Sequence
  Description of Artificial Sequence: Synthetic peptide
ADSSGYY

SEQ ID NO: 7775 - protein, 7 aa, Artificial Sequence
  Description of Artificial Sequence: Synthetic peptide
DDSSGYY

SEQ ID NO: 7776 - protein, 7 aa, Artificial Sequence
  Description of Artificial Sequence: Synthetic peptide
DDSSGYS

SEQ ID NO: 7777 - protein, 7 aa, Artificial Sequence
  Description of Artificial Sequence: Synthetic peptide
SDSSGYS

SEQ ID NO: 7778 - protein, 7 aa, Artificial Sequence
  Description of Artificial Sequence: Synthetic peptide
SDSSGYF

SEQ ID NO: 7779 - protein, 7 aa, Artificial Sequence
  Description of Artificial Sequence: Synthetic peptide
PDSSGYS

SEQ ID NO: 7780 - protein, 7 aa, Artificial Sequence
  Description of Artificial Sequence: Synthetic peptide
SDSSGYY

SEQ ID NO: 7781 - protein, 7 aa, Artificial Sequence
  Description of Artificial Sequence: Synthetic peptide
PDSSGYY

SEQ ID NO: 7782 - protein, 7 aa, Artificial Sequence
  Description of Artificial Sequence: Synthetic peptide
HDSSGYY

SEQ ID NO: 7783 - protein, 7 aa, Artificial Sequence
  Description of Artificial Sequence: Synthetic peptide
PDSSGYF

SEQ ID NO: 7784 - protein, 7 aa, Artificial Sequence
  Description of Artificial Sequence: Synthetic peptide
FDSSGYF

SEQ ID NO: 7785 - protein, 7 aa, Artificial Sequence
  Description of Artificial Sequence: Synthetic peptide
HDSSGYS

SEQ ID NO: 7786 - protein, 7 aa, Artificial Sequence
  Description of Artificial Sequence: Synthetic peptide
ADSSGYF

SEQ ID NO: 7787 - protein, 7 aa, Artificial Sequence
  Description of Artificial Sequence: Synthetic peptide
DDSSGYF

SEQ ID NO: 7788 - protein, 7 aa, Artificial Sequence
  Description of Artificial Sequence: Synthetic peptide
LDSSGYF

SEQ ID NO: 7789 - protein, 7 aa, Artificial Sequence
  Description of Artificial Sequence: Synthetic peptide
LDSSGYY

SEQ ID NO: 7790 - protein, 7 aa, Artificial Sequence
  Description of Artificial Sequence: Synthetic peptide
LDSSGYS

SEQ ID NO: 7791 - protein, 7 aa, Artificial Sequence
  Description of Artificial Sequence: Synthetic peptide
FDSSGYY

SEQ ID NO: 7792 - protein, 7 aa, Artificial Sequence
  Description of Artificial Sequence: Synthetic peptide
FDSSGYS

SEQ ID NO: 7793 - protein, 7 aa, Artificial Sequence
  Description of Artificial Sequence: Synthetic peptide
YDSSGYF

SEQ ID NO: 7794 - protein, 7 aa, Artificial Sequence
  Description of Artificial Sequence: Synthetic peptide
VDSSGYY

SEQ ID NO: 7795 - protein, 7 aa, Artificial Sequence
  Description of Artificial Sequence: Synthetic peptide
EYCGGDC

SEQ ID NO: 7796 - protein, 7 aa, Artificial Sequence
  Description of Artificial Sequence: Synthetic peptide
QYCGGDC

SEQ ID NO: 7797 - protein, 7 aa, Artificial Sequence
  Description of Artificial Sequence: Synthetic peptide
IYCGGDC

SEQ ID NO: 7798 - protein, 7 aa, Artificial Sequence
  Description of Artificial Sequence: Synthetic peptide
TYCGGDC

SEQ ID NO: 7799 - protein, 7 aa, Artificial Sequence
  Description of Artificial Sequence: Synthetic peptide
PYCGGDC

SEQ ID NO: 7800 - protein, 7 aa, Artificial Sequence
  Description of Artificial Sequence: Synthetic peptide
LYCGGDC

SEQ ID NO: 7801 - protein, 7 aa, Artificial Sequence
  Description of Artificial Sequence: Synthetic peptide
VYCGGDC

SEQ ID NO: 7802 - protein, 7 aa, Artificial Sequence
  Description of Artificial Sequence: Synthetic peptide
KYCGGDC

SEQ ID NO: 7803 - protein, 8 aa, Artificial Sequence
  Description of Artificial Sequence: Synthetic peptide
VYYDSSGF

SEQ ID NO: 7804 - protein, 8 aa, Artificial Sequence
  Description of Artificial Sequence: Synthetic peptide
IYYDSSGF

SEQ ID NO: 7805 - protein, 8 aa, Artificial Sequence
  Description of Artificial Sequence: Synthetic peptide
PYYDSSGF

SEQ ID NO: 7806 - protein, 8 aa, Artificial Sequence
  Description of Artificial Sequence: Synthetic peptide
HYYDSSGF

SEQ ID NO: 7807 - protein, 8 aa, Artificial Sequence
  Description of Artificial Sequence: Synthetic peptide
HYYDSSGY

SEQ ID NO: 7808 - protein, 8 aa, Artificial Sequence
  Description of Artificial Sequence: Synthetic peptide
AYYDSSGF

SEQ ID NO: 7809 - protein, 8 aa, Artificial Sequence
  Description of Artificial Sequence: Synthetic peptide
HYYDSSGS

SEQ ID NO: 7810 - protein, 8 aa, Artificial Sequence
  Description of Artificial Sequence: Synthetic peptide
DYYDSSGY

SEQ ID NO: 7811 - protein, 8 aa, Artificial Sequence
  Description of Artificial Sequence: Synthetic peptide
DYYDSSGS

SEQ ID NO: 7812 - protein, 8 aa, Artificial Sequence
  Description of Artificial Sequence: Synthetic peptide
YYYDSSGS

SEQ ID NO: 7813 - protein, 8 aa, Artificial Sequence
  Description of Artificial Sequence: Synthetic peptide
SYYDSSGF

SEQ ID NO: 7814 - protein, 8 aa, Artificial Sequence
  Description of Artificial Sequence: Synthetic peptide
LYYDSSGF

SEQ ID NO: 7815 - protein, 8 aa, Artificial Sequence
  Description of Artificial Sequence: Synthetic peptide
NYYDSSGF

SEQ ID NO: 7816 - protein, 8 aa, Artificial Sequence
  Description of Artificial Sequence: Synthetic peptide
NYYDSSGY

SEQ ID NO: 7817 - protein, 8 aa, Artificial Sequence
  Description of Artificial Sequence: Synthetic peptide
IYYDSSGY

SEQ ID NO: 7818 - protein, 8 aa, Artificial Sequence
  Description of Artificial Sequence: Synthetic peptide
SYYDSSGS

SEQ ID NO: 7819 - protein, 8 aa, Artificial Sequence
  Description of Artificial Sequence: Synthetic peptide
AYYDSSGS

SEQ ID NO: 7820 - protein, 8 aa, Artificial Sequence
  Description of Artificial Sequence: Synthetic peptide
IYYDSSGS

SEQ ID NO: 7821 - protein, 8 aa, Artificial Sequence
  Description of Artificial Sequence: Synthetic peptide
AYYDSSGY

SEQ ID NO: 7822 - protein, 8 aa, Artificial Sequence
  Description of Artificial Sequence: Synthetic peptide
DYYDSSGF

SEQ ID NO: 7823 - protein, 8 aa, Artificial Sequence
  Description of Artificial Sequence: Synthetic peptide
SYYDSSGY

SEQ ID NO: 7824 - protein, 8 aa, Artificial Sequence
  Description of Artificial Sequence: Synthetic peptide
NYYDSSGS

SEQ ID NO: 7825 - protein, 8 aa, Artificial Sequence
  Description of Artificial Sequence: Synthetic peptide
LYYDSSGY

SEQ ID NO: 7826 - protein, 8 aa, Artificial Sequence
  Description of Artificial Sequence: Synthetic peptide
PYYDSSGS

SEQ ID NO: 7827 - protein, 8 aa, Artificial Sequence
  Description of Artificial Sequence: Synthetic peptide
LYYDSSGS

SEQ ID NO: 7828 - protein, 8 aa, Artificial Sequence
  Description of Artificial Sequence: Synthetic peptide
PYYDSSGY

SEQ ID NO: 7829 - protein, 8 aa, Artificial Sequence
  Description of Artificial Sequence: Synthetic peptide
TYYDSSGY

SEQ ID NO: 7830 - protein, 8 aa, Artificial Sequence
  Description of Artificial Sequence: Synthetic peptide
TYYDSSGS

SEQ ID NO: 7831 - protein, 8 aa, Artificial Sequence
  Description of Artificial Sequence: Synthetic peptide
FYYDSSGF

SEQ ID NO: 7832 - protein, 8 aa, Artificial Sequence
  Description of Artificial Sequence: Synthetic peptide
FYYDSSGY

SEQ ID NO: 7833 - protein, 8 aa, Artificial Sequence
  Description of Artificial Sequence: Synthetic peptide
FYYDSSGS

SEQ ID NO: 7834 - protein, 8 aa, Artificial Sequence
  Description of Artificial Sequence: Synthetic peptide
VYYDSSGS

SEQ ID NO: 7835 - protein, 8 aa, Artificial Sequence
  Description of Artificial Sequence: Synthetic peptide
TYYDSSGF

SEQ ID NO: 7836 - protein, 8 aa, Artificial Sequence
  Description of Artificial Sequence: Synthetic peptide
YYYDSSGF

SEQ ID NO: 7837 - protein, 8 aa, Artificial Sequence
  Description of Artificial Sequence: Synthetic peptide
VYYDSSGY

SEQ ID NO: 7838 - protein, 8 aa, Artificial Sequence
  Description of Artificial Sequence: Synthetic peptide
TYYGSGSS

SEQ ID NO: 7839 - protein, 8 aa, Artificial Sequence
  Description of Artificial Sequence: Synthetic peptide
SYYGSGSY

SEQ ID NO: 7840 - protein, 8 aa, Artificial Sequence
  Description of Artificial Sequence: Synthetic peptide
SYYGSGSS

SEQ ID NO: 7841 - protein, 8 aa, Artificial Sequence
  Description of Artificial Sequence: Synthetic peptide
HYYGSGSF

SEQ ID NO: 7842 - protein, 8 aa, Artificial Sequence
  Description of Artificial Sequence: Synthetic peptide
PYYGSGSF

SEQ ID NO: 7843 - protein, 8 aa, Artificial Sequence
  Description of Artificial Sequence: Synthetic peptide
AYYGSGSS

SEQ ID NO: 7844 - protein, 8 aa, Artificial Sequence
  Description of Artificial Sequence: Synthetic peptide
AYYGSGSF

SEQ ID NO: 7845 - protein, 8 aa, Artificial Sequence
  Description of Artificial Sequence: Synthetic peptide
AYYGSGSY

SEQ ID NO: 7846 - protein, 8 aa, Artificial Sequence
  Description of Artificial Sequence: Synthetic peptide
YYYGSGSF

SEQ ID NO: 7847 - protein, 8 aa, Artificial Sequence
  Description of Artificial Sequence: Synthetic peptide
TYYGSGSY

SEQ ID NO: 7848 - protein, 8 aa, Artificial Sequence
  Description of Artificial Sequence: Synthetic peptide
PYYGSGSS

SEQ ID NO: 7849 - protein, 8 aa, Artificial Sequence
  Description of Artificial Sequence: Synthetic peptide
PYYGSGSY

SEQ ID NO: 7850 - protein, 8 aa, Artificial Sequence
  Description of Artificial Sequence: Synthetic peptide
DYYGSGSY

SEQ ID NO: 7851 - protein, 8 aa, Artificial Sequence
  Description of Artificial Sequence: Synthetic peptide
VYYGSGSY

SEQ ID NO: 7852 - protein, 8 aa, Artificial Sequence
  Description of Artificial Sequence: Synthetic peptide
VYYGSGSF

SEQ ID NO: 7853 - protein, 8 aa, Artificial Sequence
  Description of Artificial Sequence: Synthetic peptide
YYYGSGSS

SEQ ID NO: 7854 - protein, 8 aa, Artificial Sequence
  Description of Artificial Sequence: Synthetic peptide
LYYGSGSF

SEQ ID NO: 7855 - protein, 8 aa, Artificial Sequence
  Description of Artificial Sequence: Synthetic peptide
LYYGSGSY

SEQ ID NO: 7856 - protein, 8 aa, Artificial Sequence
  Description of Artificial Sequence: Synthetic peptide
DYYGSGSS

SEQ ID NO: 7857 - protein, 8 aa, Artificial Sequence
  Description of Artificial Sequence: Synthetic peptide
VYYGSGSS

SEQ ID NO: 7858 - protein, 8 aa, Artificial Sequence
  Description of Artificial Sequence: Synthetic peptide
IYYGSGSS

SEQ ID NO: 7859 - protein, 8 aa, Artificial Sequence
  Description of Artificial Sequence: Synthetic peptide
FYYGSGSY

SEQ ID NO: 7860 - protein, 8 aa, Artificial Sequence
  Description of Artificial Sequence: Synthetic peptide
FYYGSGSS

SEQ ID NO: 7861 - protein, 8 aa, Artificial Sequence
  Description of Artificial Sequence: Synthetic peptide
LYYGSGSS

SEQ ID NO: 7862 - protein, 8 aa, Artificial Sequence
  Description of Artificial Sequence: Synthetic peptide
SYYGSGSF

SEQ ID NO: 7863 - protein, 8 aa, Artificial Sequence
  Description of Artificial Sequence: Synthetic peptide
IYYGSGSY

SEQ ID NO: 7864 - protein, 8 aa, Artificial Sequence
  Description of Artificial Sequence: Synthetic peptide
IYYGSGSF

SEQ ID NO: 7865 - protein, 8 aa, Artificial Sequence
  Description of Artificial Sequence: Synthetic peptide
FYYGSGSF

SEQ ID NO: 7866 - protein, 8 aa, Artificial Sequence
  Description of Artificial Sequence: Synthetic peptide
DYYGSGSF

SEQ ID NO: 7867 - protein, 8 aa, Artificial Sequence
  Description of Artificial Sequence: Synthetic peptide
NYYGSGSS

SEQ ID NO: 7868 - protein, 8 aa, Artificial Sequence
  Description of Artificial Sequence: Synthetic peptide
NYYGSGSY

SEQ ID NO: 7869 - protein, 8 aa, Artificial Sequence
  Description of Artificial Sequence: Synthetic peptide
TYYGSGSF

SEQ ID NO: 7870 - protein, 8 aa, Artificial Sequence
  Description of Artificial Sequence: Synthetic peptide
HYYGSGSY

SEQ ID NO: 7871 - protein, 8 aa, Artificial Sequence
  Description of Artificial Sequence: Synthetic peptide
HYYGSGSS

SEQ ID NO: 7872 - protein, 8 aa, Artificial Sequence
  Description of Artificial Sequence: Synthetic peptide
NYYGSGSF

SEQ ID NO: 7873 - protein, 8 aa, Artificial Sequence
  Description of Artificial Sequence: Synthetic peptide
AYCSSTSC

SEQ ID NO: 7874 - protein, 8 aa, Artificial Sequence
  Description of Artificial Sequence: Synthetic peptide
PYCSSTSC

SEQ ID NO: 7875 - protein, 8 aa, Artificial Sequence
  Description of Artificial Sequence: Synthetic peptide
RYCSSTSC

SEQ ID NO: 7876 - protein, 8 aa, Artificial Sequence
  Description of Artificial Sequence: Synthetic peptide
IYCSSTSC

SEQ ID NO: 7877 - protein, 8 aa, Artificial Sequence
  Description of Artificial Sequence: Synthetic peptide
LYCSSTSC

SEQ ID NO: 7878 - protein, 8 aa, Artificial Sequence
  Description of Artificial Sequence: Synthetic peptide
VYCSSTSC

SEQ ID NO: 7879 - protein, 8 aa, Artificial Sequence
  Description of Artificial Sequence: Synthetic peptide
TYCSSTSC

SEQ ID NO: 7880 - protein, 8 aa, Artificial Sequence
  Description of Artificial Sequence: Synthetic peptide
SYCSSTSC

SEQ ID NO: 7881 - protein, 8 aa, Artificial Sequence
  Description of Artificial Sequence: Synthetic peptide
IYCSGGSC

SEQ ID NO: 7882 - protein, 8 aa, Artificial Sequence
  Description of Artificial Sequence: Synthetic peptide
VYCSGGSC

SEQ ID NO: 7883 - protein, 8 aa, Artificial Sequence
  Description of Artificial Sequence: Synthetic peptide
LYCSGGSC

SEQ ID NO: 7884 - protein, 8 aa, Artificial Sequence
  Description of Artificial Sequence: Synthetic peptide
AYCSGGSC

SEQ ID NO: 7885 - protein, 8 aa, Artificial Sequence
  Description of Artificial Sequence: Synthetic peptide
TYCSGGSC

SEQ ID NO: 7886 - protein, 8 aa, Artificial Sequence
  Description of Artificial Sequence: Synthetic peptide
RYCSGGSC

SEQ ID NO: 7887 - protein, 8 aa, Artificial Sequence
  Description of Artificial Sequence: Synthetic peptide
PYCSGGSC

SEQ ID NO: 7888 - protein, 8 aa, Artificial Sequence
  Description of Artificial Sequence: Synthetic peptide
SYCSGGSC

SEQ ID NO: 7889 - protein, 8 aa, Artificial Sequence
  Description of Artificial Sequence: Synthetic peptide
FYDFWSGY

SEQ ID NO: 7890 - protein, 8 aa, Artificial Sequence
  Description of Artificial Sequence: Synthetic peptide
AYDFWSGF

SEQ ID NO: 7891 - protein, 8 aa, Artificial Sequence
  Description of Artificial Sequence: Synthetic peptide
NYDFWSGF

SEQ ID NO: 7892 - protein, 8 aa, Artificial Sequence
  Description of Artificial Sequence: Synthetic peptide
IYDFWSGF

SEQ ID NO: 7893 - protein, 8 aa, Artificial Sequence
  Description of Artificial Sequence: Synthetic peptide
DYDFWSGS

SEQ ID NO: 7894 - protein, 8 aa, Artificial Sequence
  Description of Artificial Sequence: Synthetic peptide
DYDFWSGY

SEQ ID NO: 7895 - protein, 8 aa, Artificial Sequence
  Description of Artificial Sequence: Synthetic peptide
NYDFWSGY

SEQ ID NO: 7896 - protein, 8 aa, Artificial Sequence
  Description of Artificial Sequence: Synthetic peptide
VYDFWSGF

SEQ ID NO: 7897 - protein, 8 aa, Artificial Sequence
  Description of Artificial Sequence: Synthetic peptide
VYDFWSGS

SEQ ID NO: 7898 - protein, 8 aa, Artificial Sequence
  Description of Artificial Sequence: Synthetic peptide
YYDFWSGF

SEQ ID NO: 7899 - protein, 8 aa, Artificial Sequence
  Description of Artificial Sequence: Synthetic peptide
PYDFWSGF

SEQ ID NO: 7900 - protein, 8 aa, Artificial Sequence
  Description of Artificial Sequence: Synthetic peptide
FYDFWSGS

SEQ ID NO: 7901 - protein, 8 aa, Artificial Sequence
  Description of Artificial Sequence: Synthetic peptide
HYDFWSGF

SEQ ID NO: 7902 - protein, 8 aa, Artificial Sequence
  Description of Artificial Sequence: Synthetic peptide
HYDFWSGY

SEQ ID NO: 7903 - protein, 8 aa, Artificial Sequence
  Description of Artificial Sequence: Synthetic peptide
YYDFWSGS

SEQ ID NO: 7904 - protein, 8 aa, Artificial Sequence
  Description of Artificial Sequence: Synthetic peptide
PYDFWSGY

SEQ ID NO: 7905 - protein, 8 aa, Artificial Sequence
  Description of Artificial Sequence: Synthetic peptide
PYDFWSGS

SEQ ID NO: 7906 - protein, 8 aa, Artificial Sequence
  Description of Artificial Sequence: Synthetic peptide
VYDFWSGY

SEQ ID NO: 7907 - protein, 8 aa, Artificial Sequence
  Description of Artificial Sequence: Synthetic peptide
SYDFWSGS

SEQ ID NO: 7908 - protein, 8 aa, Artificial Sequence
  Description of Artificial Sequence: Synthetic peptide
LYDFWSGF

SEQ ID NO: 7909 - protein, 8 aa, Artificial Sequence
  Description of Artificial Sequence: Synthetic peptide
HYDFWSGS

SEQ ID NO: 7910 - protein, 8 aa, Artificial Sequence
  Description of Artificial Sequence: Synthetic peptide
SYDFWSGY

SEQ ID NO: 7911 - protein, 8 aa, Artificial Sequence
  Description of Artificial Sequence: Synthetic peptide
SYDFWSGF

SEQ ID NO: 7912 - protein, 8 aa, Artificial Sequence
  Description of Artificial Sequence: Synthetic peptide
LYDFWSGS

SEQ ID NO: 7913 - protein, 8 aa, Artificial Sequence
  Description of Artificial Sequence: Synthetic peptide
TYDFWSGF

SEQ ID NO: 7914 - protein, 8 aa, Artificial Sequence
  Description of Artificial Sequence: Synthetic peptide
LYDFWSGY

SEQ ID NO: 7915 - protein, 8 aa, Artificial Sequence
  Description of Artificial Sequence: Synthetic peptide
AYDFWSGY

SEQ ID NO: 7916 - protein, 8 aa, Artificial Sequence
  Description of Artificial Sequence: Synthetic peptide
AYDFWSGS

SEQ ID NO: 7917 - protein, 8 aa, Artificial Sequence
  Description of Artificial Sequence: Synthetic peptide
TYDFWSGS

SEQ ID NO: 7918 - protein, 8 aa, Artificial Sequence
  Description of Artificial Sequence: Synthetic peptide
IYDFWSGY

SEQ ID NO: 7919 - protein, 8 aa, Artificial Sequence
  Description of Artificial Sequence: Synthetic peptide
TYDFWSGY

SEQ ID NO: 7920 - protein, 8 aa, Artificial Sequence
  Description of Artificial Sequence: Synthetic peptide
NYDFWSGS

SEQ ID NO: 7921 - protein, 8 aa, Artificial Sequence
  Description of Artificial Sequence: Synthetic peptide
DYDFWSGF

SEQ ID NO: 7922 - protein, 8 aa, Artificial Sequence
  Description of Artificial Sequence: Synthetic peptide
IYDFWSGS

SEQ ID NO: 7923 - protein, 8 aa, Artificial Sequence
  Description of Artificial Sequence: Synthetic peptide
FYDFWSGF

SEQ ID NO: 7924 - protein, 8 aa, Artificial Sequence
  Description of Artificial Sequence: Synthetic peptide
HDILTGYS

SEQ ID NO: 7925 - protein, 8 aa, Artificial Sequence
  Description of Artificial Sequence: Synthetic peptide
PDILTGYY

SEQ ID NO: 7926 - protein, 8 aa, Artificial Sequence
  Description of Artificial Sequence: Synthetic peptide
PDILTGYF

SEQ ID NO: 7927 - protein, 8 aa, Artificial Sequence
  Description of Artificial Sequence: Synthetic peptide
TDILTGYS

SEQ ID NO: 7928 - protein, 8 aa, Artificial Sequence
  Description of Artificial Sequence: Synthetic peptide
HDILTGYY

SEQ ID NO: 7929 - protein, 8 aa, Artificial Sequence
  Description of Artificial Sequence: Synthetic peptide
YDILTGYF

SEQ ID NO: 7930 - protein, 8 aa, Artificial Sequence
  Description of Artificial Sequence: Synthetic peptide
IDILTGYS

SEQ ID NO: 7931 - protein, 8 aa, Artificial Sequence
  Description of Artificial Sequence: Synthetic peptide
IDILTGYY

SEQ ID NO: 7932 - protein, 8 aa, Artificial Sequence
  Description of Artificial Sequence: Synthetic peptide
IDILTGYF

SEQ ID NO: 7933 - protein, 8 aa, Artificial Sequence
  Description of Artificial Sequence: Synthetic peptide
LDILTGYF

SEQ ID NO: 7934 - protein, 8 aa, Artificial Sequence
  Description of Artificial Sequence: Synthetic peptide
LDILTGYY

SEQ ID NO: 7935 - protein, 8 aa, Artificial Sequence
  Description of Artificial Sequence: Synthetic peptide
LDILTGYS

SEQ ID NO: 7936 - protein, 8 aa, Artificial Sequence
  Description of Artificial Sequence: Synthetic peptide
DDILTGYF

SEQ ID NO: 7937 - protein, 8 aa, Artificial Sequence
  Description of Artificial Sequence: Synthetic peptide
FDILTGYF

SEQ ID NO: 7938 - protein, 8 aa, Artificial Sequence
  Description of Artificial Sequence: Synthetic peptide
SDILTGYF

SEQ ID NO: 7939 - protein, 8 aa, Artificial Sequence
  Description of Artificial Sequence: Synthetic peptide
ADILTGYY

SEQ ID NO: 7940 - protein, 8 aa, Artificial Sequence
  Description of Artificial Sequence: Synthetic peptide
VDILTGYY

SEQ ID NO: 7941 - protein, 8 aa, Artificial Sequence
  Description of Artificial Sequence: Synthetic peptide
VDILTGYS

SEQ ID NO: 7942 - protein, 8 aa, Artificial Sequence
  Description of Artificial Sequence: Synthetic peptide
ADILTGYS

SEQ ID NO: 7943 - protein, 8 aa, Artificial Sequence
  Description of Artificial Sequence: Synthetic peptide
DDILTGYS

SEQ ID NO: 7944 - protein, 8 aa, Artificial Sequence
  Description of Artificial Sequence: Synthetic peptide
FDILTGYS

SEQ ID NO: 7945 - protein, 8 aa, Artificial Sequence
  Description of Artificial Sequence: Synthetic peptide
SDILTGYS

SEQ ID NO: 7946 - protein, 8 aa, Artificial Sequence
  Description of Artificial Sequence: Synthetic peptide
DDILTGYY

SEQ ID NO: 7947 - protein, 8 aa, Artificial Sequence
  Description of Artificial Sequence: Synthetic peptide
SDILTGYY

SEQ ID NO: 7948 - protein, 8 aa, Artificial Sequence
  Description of Artificial Sequence: Synthetic peptide
FDILTGYY

SEQ ID NO: 7949 - protein, 8 aa, Artificial Sequence
  Description of Artificial Sequence: Synthetic peptide
HDILTGYF

SEQ ID NO: 7950 - protein, 8 aa, Artificial Sequence
  Description of Artificial Sequence: Synthetic peptide
NDILTGYY

SEQ ID NO: 7951 - protein, 8 aa, Artificial Sequence
  Description of Artificial Sequence: Synthetic peptide
NDILTGYF

SEQ ID NO: 7952 - protein, 8 aa, Artificial Sequence
  Description of Artificial Sequence: Synthetic peptide
PDILTGYS

SEQ ID NO: 7953 - protein, 8 aa, Artificial Sequence
  Description of Artificial Sequence: Synthetic peptide
VDILTGYF

SEQ ID NO: 7954 - protein, 8 aa, Artificial Sequence
  Description of Artificial Sequence: Synthetic peptide
TDILTGYY

SEQ ID NO: 7955 - protein, 8 aa, Artificial Sequence
  Description of Artificial Sequence: Synthetic peptide
TDILTGYF

SEQ ID NO: 7956 - protein, 8 aa, Artificial Sequence
  Description of Artificial Sequence: Synthetic peptide
YDILTGYS

SEQ ID NO: 7957 - protein, 8 aa, Artificial Sequence
  Description of Artificial Sequence: Synthetic peptide
NDILTGYS

SEQ ID NO: 7958 - protein, 8 aa, Artificial Sequence
  Description of Artificial Sequence: Synthetic peptide
ADILTGYF

SEQ ID NO: 7959 - protein, 8 aa, Artificial Sequence
  Description of Artificial Sequence: Synthetic peptide
SCSGGSCS

SEQ ID NO: 7960 - protein, 8 aa, Artificial Sequence
  Description of Artificial Sequence: Synthetic peptide
HCSGGSCF

SEQ ID NO: 7961 - protein, 8 aa, Artificial Sequence
  Description of Artificial Sequence: Synthetic peptide
DCSGGSCS

SEQ ID NO: 7962 - protein, 8 aa, Artificial Sequence
  Description of Artificial Sequence: Synthetic peptide
PCSGGSCF

SEQ ID NO: 7963 - protein, 8 aa, Artificial Sequence
  Description of Artificial Sequence: Synthetic peptide
PCSGGSCY

SEQ ID NO: 7964 - protein, 8 aa, Artificial Sequence
  Description of Artificial Sequence: Synthetic peptide
SCSGGSCY

SEQ ID NO: 7965 - protein, 8 aa, Artificial Sequence
  Description of Artificial Sequence: Synthetic peptide
PCSGGSCS

SEQ ID NO: 7966 - protein, 8 aa, Artificial Sequence
  Description of Artificial Sequence: Synthetic peptide
LCSGGSCY

SEQ ID NO: 7967 - protein, 8 aa, Artificial Sequence
  Description of Artificial Sequence: Synthetic peptide
ACSGGSCY

SEQ ID NO: 7968 - protein, 8 aa, Artificial Sequence
  Description of Artificial Sequence: Synthetic peptide
ACSGGSCS

SEQ ID NO: 7969 - protein, 8 aa, Artificial Sequence
  Description of Artificial Sequence: Synthetic peptide
ACSGGSCF

SEQ ID NO: 7970 - protein, 8 aa, Artificial Sequence
  Description of Artificial Sequence: Synthetic peptide
VCSGGSCY

SEQ ID NO: 7971 - protein, 8 aa, Artificial Sequence
  Description of Artificial Sequence: Synthetic peptide
VCSGGSCF

SEQ ID NO: 7972 - protein, 8 aa, Artificial Sequence
  Description of Artificial Sequence: Synthetic peptide
VCSGGSCS

SEQ ID NO: 7973 - protein, 8 aa, Artificial Sequence
  Description of Artificial Sequence: Synthetic peptide
YCSGGSCS

SEQ ID NO: 7974 - protein, 8 aa, Artificial Sequence
  Description of Artificial Sequence: Synthetic peptide
YCSGGSCF

SEQ ID NO: 7975 - protein, 8 aa, Artificial Sequence
  Description of Artificial Sequence: Synthetic peptide
DCSGGSCF

SEQ ID NO: 7976 - protein, 8 aa, Artificial Sequence
  Description of Artificial Sequence: Synthetic peptide
DCSGGSCY

SEQ ID NO: 7977 - protein, 8 aa, Artificial Sequence
  Description of Artificial Sequence: Synthetic peptide
FCSGGSCS

SEQ ID NO: 7978 - protein, 8 aa, Artificial Sequence
  Description of Artificial Sequence: Synthetic peptide
FCSGGSCY

SEQ ID NO: 7979 - protein, 8 aa, Artificial Sequence
  Description of Artificial Sequence: Synthetic peptide
FCSGGSCF

SEQ ID NO: 7980 - protein, 8 aa, Artificial Sequence
  Description of Artificial Sequence: Synthetic peptide
SCSGGSCF

SEQ ID NO: 7981 - protein, 8 aa, Artificial Sequence
  Description of Artificial Sequence: Synthetic peptide
LCSGGSCF

SEQ ID NO: 7982 - protein, 8 aa, Artificial Sequence
  Description of Artificial Sequence: Synthetic peptide
LCSGGSCS

SEQ ID NO: 7983 - protein, 8 aa, Artificial Sequence
  Description of Artificial Sequence: Synthetic peptide
HCSGGSCS

SEQ ID NO: 7984 - protein, 8 aa, Artificial Sequence
  Description of Artificial Sequence: Synthetic peptide
HCSGGSCY

SEQ ID NO: 7985 - protein, 8 aa, Artificial Sequence
  Description of Artificial Sequence: Synthetic peptide
ACSSTSCY

SEQ ID NO: 7986 - protein, 8 aa, Artificial Sequence
  Description of Artificial Sequence: Synthetic peptide
YCSSTSCF

SEQ ID NO: 7987 - protein, 8 aa, Artificial Sequence
  Description of Artificial Sequence: Synthetic peptide
FCSSTSCY

SEQ ID NO: 7988 - protein, 8 aa, Artificial Sequence
  Description of Artificial Sequence: Synthetic peptide
PCSSTSCF

SEQ ID NO: 7989 - protein, 8 aa, Artificial Sequence
  Description of Artificial Sequence: Synthetic peptide
FCSSTSCS

SEQ ID NO: 7990 - protein, 8 aa, Artificial Sequence
  Description of Artificial Sequence: Synthetic peptide
DCSSTSCF

SEQ ID NO: 7991 - protein, 8 aa, Artificial Sequence
  Description of Artificial Sequence: Synthetic peptide
VCSSTSCS

SEQ ID NO: 7992 - protein, 8 aa, Artificial Sequence
  Description of Artificial Sequence: Synthetic peptide
VCSSTSCF

SEQ ID NO: 7993 - protein, 8 aa, Artificial Sequence
  Description of Artificial Sequence: Synthetic peptide
LCSSTSCS

SEQ ID NO: 7994 - protein, 8 aa, Artificial Sequence
  Description of Artificial Sequence: Synthetic peptide
VCSSTSCY

SEQ ID NO: 7995 - protein, 8 aa, Artificial Sequence
  Description of Artificial Sequence: Synthetic peptide
ACSSTSCS

SEQ ID NO: 7996 - protein, 8 aa, Artificial Sequence
  Description of Artificial Sequence: Synthetic peptide
LCSSTSCY

SEQ ID NO: 7997 - protein, 8 aa, Artificial Sequence
  Description of Artificial Sequence: Synthetic peptide
LCSSTSCF

SEQ ID NO: 7998 - protein, 8 aa, Artificial Sequence
  Description of Artificial Sequence: Synthetic peptide
FCSSTSCF

SEQ ID NO: 7999 - protein, 8 aa, Artificial Sequence
  Description of Artificial Sequence: Synthetic peptide
HCSSTSCY

SEQ ID NO: 8000 - protein, 8 aa, Artificial Sequence
  Description of Artificial Sequence: Synthetic peptide
HCSSTSCS

SEQ ID NO: 8001 - protein, 8 aa, Artificial Sequence
  Description of Artificial Sequence: Synthetic peptide
HCSSTSCF

SEQ ID NO: 8002 - protein, 8 aa, Artificial Sequence
  Description of Artificial Sequence: Synthetic peptide
SCSSTSCF

SEQ ID NO: 8003 - protein, 8 aa, Artificial Sequence
  Description of Artificial Sequence: Synthetic peptide
SCSSTSCS

SEQ ID NO: 8004 - protein, 8 aa, Artificial Sequence
  Description of Artificial Sequence: Synthetic peptide
YCSSTSCS

SEQ ID NO: 8005 - protein, 8 aa, Artificial Sequence
  Description of Artificial Sequence: Synthetic peptide
DCSSTSCY

SEQ ID NO: 8006 - protein, 8 aa, Artificial Sequence
  Description of Artificial Sequence: Synthetic peptide
DCSSTSCS

SEQ ID NO: 8007 - protein, 8 aa, Artificial Sequence
  Description of Artificial Sequence: Synthetic peptide
SCSSTSCY

SEQ ID NO: 8008 - protein, 8 aa, Artificial Sequence
  Description of Artificial Sequence: Synthetic peptide
PCSSTSCS

SEQ ID NO: 8009 - protein, 8 aa, Artificial Sequence
  Description of Artificial Sequence: Synthetic peptide
ACSSTSCF

SEQ ID NO: 8010 - protein, 8 aa, Artificial Sequence
  Description of Artificial Sequence: Synthetic peptide
PCSSTSCY

SEQ ID NO: 8011 - protein, 8 aa, Artificial Sequence
  Description of Artificial Sequence: Synthetic peptide
LYCGGDCS

SEQ ID NO: 8012 - protein, 8 aa, Artificial Sequence
  Description of Artificial Sequence: Synthetic peptide
EYCGGDCS

SEQ ID NO: 8013 - protein, 8 aa, Artificial Sequence
  Description of Artificial Sequence: Synthetic peptide
LYCGGDCY

SEQ ID NO: 8014 - protein, 8 aa, Artificial Sequence
  Description of Artificial Sequence: Synthetic peptide
VYCGGDCS

SEQ ID NO: 8015 - protein, 8 aa, Artificial Sequence
  Description of Artificial Sequence: Synthetic peptide
VYCGGDCY

SEQ ID NO: 8016 - protein, 8 aa, Artificial Sequence
  Description of Artificial Sequence: Synthetic peptide
AYCGGDCF

SEQ ID NO: 8017 - protein, 8 aa, Artificial Sequence
  Description of Artificial Sequence: Synthetic peptide
EYCGGDCY

SEQ ID NO: 8018 - protein, 8 aa, Artificial Sequence
  Description of Artificial Sequence: Synthetic peptide
TYCGGDCF

SEQ ID NO: 8019 - protein, 8 aa, Artificial Sequence
  Description of Artificial Sequence: Synthetic peptide
LYCGGDCF

SEQ ID NO: 8020 - protein, 8 aa, Artificial Sequence
  Description of Artificial Sequence: Synthetic peptide
AYCGGDCS

SEQ ID NO: 8021 - protein, 8 aa, Artificial Sequence
  Description of Artificial Sequence: Synthetic peptide
QYCGGDCF

SEQ ID NO: 8022 - protein, 8 aa, Artificial Sequence
  Description of Artificial Sequence: Synthetic peptide
QYCGGDCS

SEQ ID NO: 8023 - protein, 8 aa, Artificial Sequence
  Description of Artificial Sequence: Synthetic peptide
KYCGGDCF

SEQ ID NO: 8024 - protein, 8 aa, Artificial Sequence
  Description of Artificial Sequence: Synthetic peptide
KYCGGDCY

SEQ ID NO: 8025 - protein, 8 aa, Artificial Sequence
  Description of Artificial Sequence: Synthetic peptide
QYCGGDCY

SEQ ID NO: 8026 - protein, 8 aa, Artificial Sequence
  Description of Artificial Sequence: Synthetic peptide
KYCGGDCS

SEQ ID NO: 8027 - protein, 8 aa, Artificial Sequence
  Description of Artificial Sequence: Synthetic peptide
VYCGGDCF

SEQ ID NO: 8028 - protein, 8 aa, Artificial Sequence
  Description of Artificial Sequence: Synthetic peptide
IYCGGDCF

SEQ ID NO: 8029 - protein, 8 aa, Artificial Sequence
  Description of Artificial Sequence: Synthetic peptide
IYCGGDCY

SEQ ID NO: 8030 - protein, 8 aa, Artificial Sequence
  Description of Artificial Sequence: Synthetic peptide
IYCGGDCS

SEQ ID NO: 8031 - protein, 8 aa, Artificial Sequence
  Description of Artificial Sequence: Synthetic peptide
PYCGGDCS

SEQ ID NO: 8032 - protein, 8 aa, Artificial Sequence
  Description of Artificial Sequence: Synthetic peptide
PYCGGDCF

SEQ ID NO: 8033 - protein, 8 aa, Artificial Sequence
  Description of Artificial Sequence: Synthetic peptide
TYCGGDCY

SEQ ID NO: 8034 - protein, 8 aa, Artificial Sequence
  Description of Artificial Sequence: Synthetic peptide
EYCGGDCF

SEQ ID NO: 8035 - protein, 8 aa, Artificial Sequence
  Description of Artificial Sequence: Synthetic peptide
PYCGGDCY

SEQ ID NO: 8036 - protein, 8 aa, Artificial Sequence
  Description of Artificial Sequence: Synthetic peptide
TYCGGDCS

SEQ ID NO: 8037 - protein, 8 aa, Artificial Sequence
  Description of Artificial Sequence: Synthetic peptide
DYDSSGYS

SEQ ID NO: 8038 - protein, 8 aa, Artificial Sequence
  Description of Artificial Sequence: Synthetic peptide
YYDSSGYF

SEQ ID NO: 8039 - protein, 8 aa, Artificial Sequence
  Description of Artificial Sequence: Synthetic peptide
LYDSSGYS

SEQ ID NO: 8040 - protein, 8 aa, Artificial Sequence
  Description of Artificial Sequence: Synthetic peptide
AYDSSGYS

SEQ ID NO: 8041 - protein, 8 aa, Artificial Sequence
  Description of Artificial Sequence: Synthetic peptide
AYDSSGYY

SEQ ID NO: 8042 - protein, 8 aa, Artificial Sequence
  Description of Artificial Sequence: Synthetic peptide
NYDSSGYY

SEQ ID NO: 8043 - protein, 8 aa, Artificial Sequence
  Description of Artificial Sequence: Synthetic peptide
IYDSSGYS

SEQ ID NO: 8044 - protein, 8 aa, Artificial Sequence
  Description of Artificial Sequence: Synthetic peptide
FYDSSGYF

SEQ ID NO: 8045 - protein, 8 aa, Artificial Sequence
  Description of Artificial Sequence: Synthetic peptide
DYDSSGYY

SEQ ID NO: 8046 - protein, 8 aa, Artificial Sequence
  Description of Artificial Sequence: Synthetic peptide
YYDSSGYS

SEQ ID NO: 8047 - protein, 8 aa, Artificial Sequence
  Description of Artificial Sequence: Synthetic peptide
TYDSSGYY

SEQ ID NO: 8048 - protein, 8 aa, Artificial Sequence
  Description of Artificial Sequence: Synthetic peptide
TYDSSGYS

SEQ ID NO: 8049 - protein, 8 aa, Artificial Sequence
  Description of Artificial Sequence: Synthetic peptide
PYDSSGYF

SEQ ID NO: 8050 - protein, 8 aa, Artificial Sequence
  Description of Artificial Sequence: Synthetic peptide
IYDSSGYY

SEQ ID NO: 8051 - protein, 8 aa, Artificial Sequence
  Description of Artificial Sequence: Synthetic peptide
IYDSSGYF

SEQ ID NO: 8052 - protein, 8 aa, Artificial Sequence
  Description of Artificial Sequence: Synthetic peptide
NYDSSGYS

SEQ ID NO: 8053 - protein, 8 aa, Artificial Sequence
  Description of Artificial Sequence: Synthetic peptide
NYDSSGYF

SEQ ID NO: 8054 - protein, 8 aa, Artificial Sequence
  Description of Artificial Sequence: Synthetic peptide
VYDSSGYY

SEQ ID NO: 8055 - protein, 8 aa, Artificial Sequence
  Description of Artificial Sequence: Synthetic peptide
VYDSSGYF

SEQ ID NO: 8056 - protein, 8 aa, Artificial Sequence
  Description of Artificial Sequence: Synthetic peptide
FYDSSGYY

SEQ ID NO: 8057 - protein, 8 aa, Artificial Sequence
  Description of Artificial Sequence: Synthetic peptide
FYDSSGYS

SEQ ID NO: 8058 - protein, 8 aa, Artificial Sequence
  Description of Artificial Sequence: Synthetic peptide
SYDSSGYY

SEQ ID NO: 8059 - protein, 8 aa, Artificial Sequence
  Description of Artificial Sequence: Synthetic peptide
SYDSSGYS

SEQ ID NO: 8060 - protein, 8 aa, Artificial Sequence
  Description of Artificial Sequence: Synthetic peptide
PYDSSGYS

SEQ ID NO: 8061 - protein, 8 aa, Artificial Sequence
  Description of Artificial Sequence: Synthetic peptide
PYDSSGYY

SEQ ID NO: 8062 - protein, 8 aa, Artificial Sequence
  Description of Artificial Sequence: Synthetic peptide
LYDSSGYY

SEQ ID NO: 8063 - protein, 8 aa, Artificial Sequence
  Description of Artificial Sequence: Synthetic peptide
VYDSSGYS

SEQ ID NO: 8064 - protein, 8 aa, Artificial Sequence
  Description of Artificial Sequence: Synthetic peptide
SYDSSGYF

SEQ ID NO: 8065 - protein, 8 aa, Artificial Sequence
  Description of Artificial Sequence: Synthetic peptide
LYDSSGYF

SEQ ID NO: 8066 - protein, 8 aa, Artificial Sequence
  Description of Artificial Sequence: Synthetic peptide
HYDSSGYY

SEQ ID NO: 8067 - protein, 8 aa, Artificial Sequence
  Description of Artificial Sequence: Synthetic peptide
HYDSSGYS

SEQ ID NO: 8068 - protein, 8 aa, Artificial Sequence
  Description of Artificial Sequence: Synthetic peptide
TYDSSGYF

SEQ ID NO: 8069 - protein, 8 aa, Artificial Sequence
  Description of Artificial Sequence: Synthetic peptide
AYDSSGYF

SEQ ID NO: 8070 - protein, 8 aa, Artificial Sequence
  Description of Artificial Sequence: Synthetic peptide
DYDSSGYF

SEQ ID NO: 8071 - protein, 8 aa, Artificial Sequence
  Description of Artificial Sequence: Synthetic peptide
HYDSSGYF

SEQ ID NO: 8072 - protein, 8 aa, Artificial Sequence
  Description of Artificial Sequence: Synthetic peptide
RYYGSGSY

SEQ ID NO: 8073 - protein, 8 aa, Artificial Sequence
  Description of Artificial Sequence: Synthetic peptide
RYYGSGSS

SEQ ID NO: 8074 - protein, 8 aa, Artificial Sequence
  Description of Artificial Sequence: Synthetic peptide
GYYGSGSS

SEQ ID NO: 8075 - protein, 8 aa, Artificial Sequence
  Description of Artificial Sequence: Synthetic peptide
GYYGSGSY

SEQ ID NO: 8076 - protein, 8 aa, Artificial Sequence
  Description of Artificial Sequence: Synthetic peptide
FDFWSGYS

SEQ ID NO: 8077 - protein, 8 aa, Artificial Sequence
  Description of Artificial Sequence: Synthetic peptide
HDFWSGYF

SEQ ID NO: 8078 - protein, 8 aa, Artificial Sequence
  Description of Artificial Sequence: Synthetic peptide
FDFWSGYY

SEQ ID NO: 8079 - protein, 8 aa, Artificial Sequence
  Description of Artificial Sequence: Synthetic peptide
SDFWSGYS

SEQ ID NO: 8080 - protein, 8 aa, Artificial Sequence
  Description of Artificial Sequence: Synthetic peptide
SDFWSGYY

SEQ ID NO: 8081 - protein, 8 aa, Artificial Sequence
  Description of Artificial Sequence: Synthetic peptide
PDFWSGYS

SEQ ID NO: 8082 - protein, 8 aa, Artificial Sequence
  Description of Artificial Sequence: Synthetic peptide
HDFWSGYS

SEQ ID NO: 8083 - protein, 8 aa, Artificial Sequence
  Description of Artificial Sequence: Synthetic peptide
IDFWSGYY

SEQ ID NO: 8084 - protein, 8 aa, Artificial Sequence
  Description of Artificial Sequence: Synthetic peptide
HDFWSGYY

SEQ ID NO: 8085 - protein, 8 aa, Artificial Sequence
  Description of Artificial Sequence: Synthetic peptide
NDFWSGYF

SEQ ID NO: 8086 - protein, 8 aa, Artificial Sequence
  Description of Artificial Sequence: Synthetic peptide
YDFWSGYS

SEQ ID NO: 8087 - protein, 8 aa, Artificial Sequence
  Description of Artificial Sequence: Synthetic peptide
IDFWSGYS

SEQ ID NO: 8088 - protein, 8 aa, Artificial Sequence
  Description of Artificial Sequence: Synthetic peptide
PDFWSGYY

SEQ ID NO: 8089 - protein, 8 aa, Artificial Sequence
  Description of Artificial Sequence: Synthetic peptide
SDFWSGYF

SEQ ID NO: 8090 - protein, 8 aa, Artificial Sequence
  Description of Artificial Sequence: Synthetic peptide
VDFWSGYS

SEQ ID NO: 8091 - protein, 8 aa, Artificial Sequence
  Description of Artificial Sequence: Synthetic peptide
IDFWSGYF

SEQ ID NO: 8092 - protein, 8 aa, Artificial Sequence
  Description of Artificial Sequence: Synthetic peptide
YDFWSGYF

SEQ ID NO: 8093 - protein, 8 aa, Artificial Sequence
  Description of Artificial Sequence: Synthetic peptide
TDFWSGYY

SEQ ID NO: 8094 - protein, 8 aa, Artificial Sequence
  Description of Artificial Sequence: Synthetic peptide
DDFWSGYS

SEQ ID NO: 8095 - protein, 8 aa, Artificial Sequence
  Description of Artificial Sequence: Synthetic peptide
LDFWSGYS

SEQ ID NO: 8096 - protein, 8 aa, Artificial Sequence
  Description of Artificial Sequence: Synthetic peptide
DDFWSGYY

SEQ ID NO: 8097 - protein, 8 aa, Artificial Sequence
  Description of Artificial Sequence: Synthetic peptide
DDFWSGYF

SEQ ID NO: 8098 - protein, 8 aa, Artificial Sequence
  Description of Artificial Sequence: Synthetic peptide
VDFWSGYY

SEQ ID NO: 8099 - protein, 8 aa, Artificial Sequence
  Description of Artificial Sequence: Synthetic peptide
VDFWSGYF

SEQ ID NO: 8100 - protein, 8 aa, Artificial Sequence
  Description of Artificial Sequence: Synthetic peptide
NDFWSGYY

SEQ ID NO: 8101 - protein, 8 aa, Artificial Sequence
  Description of Artificial Sequence: Synthetic peptide
FDFWSGYF

SEQ ID NO: 8102 - protein, 8 aa, Artificial Sequence
  Description of Artificial Sequence: Synthetic peptide
NDFWSGYS

SEQ ID NO: 8103 - protein, 8 aa, Artificial Sequence
  Description of Artificial Sequence: Synthetic peptide
LDFWSGYY

SEQ ID NO: 8104 - protein, 8 aa, Artificial Sequence
  Description of Artificial Sequence: Synthetic peptide
ADFWSGYY

SEQ ID NO: 8105 - protein, 8 aa, Artificial Sequence
  Description of Artificial Sequence: Synthetic peptide
ADFWSGYS

SEQ ID NO: 8106 - protein, 8 aa, Artificial Sequence
  Description of Artificial Sequence: Synthetic peptide
TDFWSGYS

SEQ ID NO: 8107 - protein, 8 aa, Artificial Sequence
  Description of Artificial Sequence: Synthetic peptide
TDFWSGYF

SEQ ID NO: 8108 - protein, 8 aa, Artificial Sequence
  Description of Artificial Sequence: Synthetic peptide
ADFWSGYF

SEQ ID NO: 8109 - protein, 8 aa, Artificial Sequence
  Description of Artificial Sequence: Synthetic peptide
LDFWSGYF

SEQ ID NO: 8110 - protein, 8 aa, Artificial Sequence
  Description of Artificial Sequence: Synthetic peptide
PDFWSGYF

SEQ ID NO: 8111 - protein, 8 aa, Artificial Sequence
  Description of Artificial Sequence: Synthetic peptide
LLRYFDWY

SEQ ID NO: 8112 - protein, 8 aa, Artificial Sequence
  Description of Artificial Sequence: Synthetic peptide
QLRYFDWY

SEQ ID NO: 8113 - protein, 8 aa, Artificial Sequence
  Description of Artificial Sequence: Synthetic peptide
PLRYFDWL

SEQ ID NO: 8114 - protein, 8 aa, Artificial Sequence
  Description of Artificial Sequence: Synthetic peptide
ILRYFDWF

SEQ ID NO: 8115 - protein, 8 aa, Artificial Sequence
  Description of Artificial Sequence: Synthetic peptide
ILRYFDWY

SEQ ID NO: 8116 - protein, 8 aa, Artificial Sequence
  Description of Artificial Sequence: Synthetic peptide
ALRYFDWL

SEQ ID NO: 8117 - protein, 8 aa, Artificial Sequence
  Description of Artificial Sequence: Synthetic peptide
QLRYFDWF

SEQ ID NO: 8118 - protein, 8 aa, Artificial Sequence
  Description of Artificial Sequence: Synthetic peptide
KLRYFDWL

SEQ ID NO: 8119 - protein, 8 aa, Artificial Sequence
  Description of Artificial Sequence: Synthetic peptide
TLRYFDWL

SEQ ID NO: 8120 - protein, 8 aa, Artificial Sequence
  Description of Artificial Sequence: Synthetic peptide
TLRYFDWH

SEQ ID NO: 8121 - protein, 8 aa, Artificial Sequence
  Description of Artificial Sequence: Synthetic peptide
ELRYFDWL

SEQ ID NO: 8122 - protein, 8 aa, Artificial Sequence
  Description of Artificial Sequence: Synthetic peptide
ELRYFDWH

SEQ ID NO: 8123 - protein, 8 aa, Artificial Sequence
  Description of Artificial Sequence: Synthetic peptide
PLRYFDWH

SEQ ID NO: 8124 - protein, 8 aa, Artificial Sequence
  Description of Artificial Sequence: Synthetic peptide
ELRYFDWY

SEQ ID NO: 8125 - protein, 8 aa, Artificial Sequence
  Description of Artificial Sequence: Synthetic peptide
ELRYFDWF

SEQ ID NO: 8126 - protein, 8 aa, Artificial Sequence
  Description of Artificial Sequence: Synthetic peptide
LLRYFDWL

SEQ ID NO: 8127 - protein, 8 aa, Artificial Sequence
  Description of Artificial Sequence: Synthetic peptide
VLRYFDWF

SEQ ID NO: 8128 - protein, 8 aa, Artificial Sequence
  Description of Artificial Sequence: Synthetic peptide
TLRYFDWF

SEQ ID NO: 8129 - protein, 8 aa, Artificial Sequence
  Description of Artificial Sequence: Synthetic peptide
ALRYFDWF

SEQ ID NO: 8130 - protein, 8 aa, Artificial Sequence
  Description of Artificial Sequence: Synthetic peptide
ILRYFDWH

SEQ ID NO: 8131 - protein, 8 aa, Artificial Sequence
  Description of Artificial Sequence: Synthetic peptide
QLRYFDWL

SEQ ID NO: 8132 - protein, 8 aa, Artificial Sequence
  Description of Artificial Sequence: Synthetic peptide
QLRYFDWH

SEQ ID NO: 8133 - protein, 8 aa, Artificial Sequence
  Description of Artificial Sequence: Synthetic peptide
VLRYFDWY

SEQ ID NO: 8134 - protein, 8 aa, Artificial Sequence
  Description of Artificial Sequence: Synthetic peptide
TLRYFDWY

SEQ ID NO: 8135 - protein, 8 aa, Artificial Sequence
  Description of Artificial Sequence: Synthetic peptide
ILRYFDWL

SEQ ID NO: 8136 - protein, 8 aa, Artificial Sequence
  Description of Artificial Sequence: Synthetic peptide
LLRYFDWH

SEQ ID NO: 8137 - protein, 8 aa, Artificial Sequence
  Description of Artificial Sequence: Synthetic peptide
VLRYFDWH

SEQ ID NO: 8138 - protein, 8 aa, Artificial Sequence
  Description of Artificial Sequence: Synthetic peptide
KLRYFDWY

SEQ ID NO: 8139 - protein, 8 aa, Artificial Sequence
  Description of Artificial Sequence: Synthetic peptide
KLRYFDWF

SEQ ID NO: 8140 - protein, 8 aa, Artificial Sequence
  Description of Artificial Sequence: Synthetic peptide
ALRYFDWH

SEQ ID NO: 8141 - protein, 8 aa, Artificial Sequence
  Description of Artificial Sequence: Synthetic peptide
ALRYFDWY

SEQ ID NO: 8142 - protein, 8 aa, Artificial Sequence
  Description of Artificial Sequence: Synthetic peptide
KLRYFDWH

SEQ ID NO: 8143 - protein, 8 aa, Artificial Sequence
  Description of Artificial Sequence: Synthetic peptide
PLRYFDWY

SEQ ID NO: 8144 - protein, 8 aa, Artificial Sequence
  Description of Artificial Sequence: Synthetic peptide
PLRYFDWF

SEQ ID NO: 8145 - protein, 8 aa, Artificial Sequence
  Description of Artificial Sequence: Synthetic peptide
LLRYFDWF

SEQ ID NO: 8146 - protein, 9 aa, Artificial Sequence
  Description of Artificial Sequence: Synthetic peptide
IYYDSSGYS

SEQ ID NO: 8147 - protein, 9 aa, Artificial Sequence
  Description of Artificial Sequence: Synthetic peptide
TYYDSSGYS

SEQ ID NO: 8148 - protein, 9 aa, Artificial Sequence
  Description of Artificial Sequence: Synthetic peptide
HYYDSSGYY

SEQ ID NO: 8149 - protein, 9 aa, Artificial Sequence
  Description of Artificial Sequence: Synthetic peptide
TYYDSSGYY

SEQ ID NO: 8150 - protein, 9 aa, Artificial Sequence
  Description of Artificial Sequence: Synthetic peptide
HYYDSSGYS

SEQ ID NO: 8151 - protein, 9 aa, Artificial Sequence
  Description of Artificial Sequence: Synthetic peptide
NYYDSSGYF

SEQ ID NO: 8152 - protein, 9 aa, Artificial Sequence
  Description of Artificial Sequence: Synthetic peptide
AYYDSSGYS

SEQ ID NO: 8153 - protein, 9 aa, Artificial Sequence
  Description of Artificial Sequence: Synthetic peptide
DYYDSSGYF

SEQ ID NO: 8154 - protein, 9 aa, Artificial Sequence
  Description of Artificial Sequence: Synthetic peptide
DYYDSSGYS

SEQ ID NO: 8155 - protein, 9 aa, Artificial Sequence
  Description of Artificial Sequence: Synthetic peptide
LYYDSSGYS

SEQ ID NO: 8156 - protein, 9 aa, Artificial Sequence
  Description of Artificial Sequence: Synthetic peptide
NYYDSSGYS

SEQ ID NO: 8157 - protein, 9 aa, Artificial Sequence
  Description of Artificial Sequence: Synthetic peptide
HYYDSSGYF

SEQ ID NO: 8158 - protein, 9 aa, Artificial Sequence
  Description of Artificial Sequence: Synthetic peptide
DYYDSSGYY

SEQ ID NO: 8159 - protein, 9 aa, Artificial Sequence
  Description of Artificial Sequence: Synthetic peptide
LYYDSSGYY

SEQ ID NO: 8160 - protein, 9 aa, Artificial Sequence
  Description of Artificial Sequence: Synthetic peptide
IYYDSSGYY

SEQ ID NO: 8161 - protein, 9 aa, Artificial Sequence
  Description of Artificial Sequence: Synthetic peptide
LYYDSSGYF

SEQ ID NO: 8162 - protein, 9 aa, Artificial Sequence
  Description of Artificial Sequence: Synthetic peptide
IYYDSSGYF

SEQ ID NO: 8163 - protein, 9 aa, Artificial Sequence
  Description of Artificial Sequence: Synthetic peptide
AYYDSSGYF

SEQ ID NO: 8164 - protein, 9 aa, Artificial Sequence
  Description of Artificial Sequence: Synthetic peptide
AYYDSSGYY

SEQ ID NO: 8165 - protein, 9 aa, Artificial Sequence
  Description of Artificial Sequence: Synthetic peptide
FYYDSSGYS

SEQ ID NO: 8166 - protein, 9 aa, Artificial Sequence
  Description of Artificial Sequence: Synthetic peptide
YYYDSSGYS

SEQ ID NO: 8167 - protein, 9 aa, Artificial Sequence
  Description of Artificial Sequence: Synthetic peptide
FYYDSSGYY

SEQ ID NO: 8168 - protein, 9 aa, Artificial Sequence
  Description of Artificial Sequence: Synthetic peptide
FYYDSSGYF

SEQ ID NO: 8169 - protein, 9 aa, Artificial Sequence
  Description of Artificial Sequence: Synthetic peptide
YYYDSSGYF

SEQ ID NO: 8170 - protein, 9 aa, Artificial Sequence
  Description of Artificial Sequence: Synthetic peptide
VYYDSSGYF

SEQ ID NO: 8171 - protein, 9 aa, Artificial Sequence
  Description of Artificial Sequence: Synthetic peptide
PYYDSSGYY

SEQ ID NO: 8172 - protein, 9 aa, Artificial Sequence
  Description of Artificial Sequence: Synthetic peptide
PYYDSSGYS

SEQ ID NO: 8173 - protein, 9 aa, Artificial Sequence
  Description of Artificial Sequence: Synthetic peptide
VYYDSSGYS

SEQ ID NO: 8174 - protein, 9 aa, Artificial Sequence
  Description of Artificial Sequence: Synthetic peptide
SYYDSSGYY

SEQ ID NO: 8175 - protein, 9 aa, Artificial Sequence
  Description of Artificial Sequence: Synthetic peptide
NYYDSSGYY

SEQ ID NO: 8176 - protein, 9 aa, Artificial Sequence
  Description of Artificial Sequence: Synthetic peptide
VYYDSSGYY

SEQ ID NO: 8177 - protein, 9 aa, Artificial Sequence
  Description of Artificial Sequence: Synthetic peptide
SYYDSSGYS

SEQ ID NO: 8178 - protein, 9 aa, Artificial Sequence
  Description of Artificial Sequence: Synthetic peptide
SYYDSSGYF

SEQ ID NO: 8179 - protein, 9 aa, Artificial Sequence
  Description of Artificial Sequence: Synthetic peptide
TYYDSSGYF

SEQ ID NO: 8180 - protein, 9 aa, Artificial Sequence
  Description of Artificial Sequence: Synthetic peptide
PYYDSSGYF

SEQ ID NO: 8181 - protein, 9 aa, Artificial Sequence
  Description of Artificial Sequence: Synthetic peptide
PYCSGGSCF

SEQ ID NO: 8182 - protein, 9 aa, Artificial Sequence
  Description of Artificial Sequence: Synthetic peptide
TYCSGGSCF

SEQ ID NO: 8183 - protein, 9 aa, Artificial Sequence
  Description of Artificial Sequence: Synthetic peptide
IYCSGGSCF

SEQ ID NO: 8184 - protein, 9 aa, Artificial Sequence
  Description of Artificial Sequence: Synthetic peptide
VYCSGGSCS

SEQ ID NO: 8185 - protein, 9 aa, Artificial Sequence
  Description of Artificial Sequence: Synthetic peptide
TYCSGGSCY

SEQ ID NO: 8186 - protein, 9 aa, Artificial Sequence
  Description of Artificial Sequence: Synthetic peptide
VYCSGGSCF

SEQ ID NO: 8187 - protein, 9 aa, Artificial Sequence
  Description of Artificial Sequence: Synthetic peptide
TYCSGGSCS

SEQ ID NO: 8188 - protein, 9 aa, Artificial Sequence
  Description of Artificial Sequence: Synthetic peptide
GYCSGGSCS

SEQ ID NO: 8189 - protein, 9 aa, Artificial Sequence
  Description of Artificial Sequence: Synthetic peptide
IYCSGGSCS

SEQ ID NO: 8190 - protein, 9 aa, Artificial Sequence
  Description of Artificial Sequence: Synthetic peptide
IYCSGGSCY

SEQ ID NO: 8191 - protein, 9 aa, Artificial Sequence
  Description of Artificial Sequence: Synthetic peptide
VYCSGGSCY

SEQ ID NO: 8192 - protein, 9 aa, Artificial Sequence
  Description of Artificial Sequence: Synthetic peptide
AYCSGGSCF

SEQ ID NO: 8193 - protein, 9 aa, Artificial Sequence
  Description of Artificial Sequence: Synthetic peptide
GYCSGGSCF

SEQ ID NO: 8194 - protein, 9 aa, Artificial Sequence
  Description of Artificial Sequence: Synthetic peptide
LYCSGGSCF

SEQ ID NO: 8195 - protein, 9 aa, Artificial Sequence
  Description of Artificial Sequence: Synthetic peptide
RYCSGGSCF

SEQ ID NO: 8196 - protein, 9 aa, Artificial Sequence
  Description of Artificial Sequence: Synthetic peptide
LYCSGGSCS

SEQ ID NO: 8197 - protein, 9 aa, Artificial Sequence
  Description of Artificial Sequence: Synthetic peptide
RYCSGGSCY

SEQ ID NO: 8198 - protein, 9 aa, Artificial Sequence
  Description of Artificial Sequence: Synthetic peptide
AYCSGGSCS

SEQ ID NO: 8199 - protein, 9 aa, Artificial Sequence
  Description of Artificial Sequence: Synthetic peptide
SYCSGGSCY

SEQ ID NO: 8200 - protein, 9 aa, Artificial Sequence
  Description of Artificial Sequence: Synthetic peptide
SYCSGGSCF

SEQ ID NO: 8201 - protein, 9 aa, Artificial Sequence
  Description of Artificial Sequence: Synthetic peptide
AYCSGGSCY

SEQ ID NO: 8202 - protein, 9 aa, Artificial Sequence
  Description of Artificial Sequence: Synthetic peptide
SYCSGGSCS

SEQ ID NO: 8203 - protein, 9 aa, Artificial Sequence
  Description of Artificial Sequence: Synthetic peptide
PYCSGGSCS

SEQ ID NO: 8204 - protein, 9 aa, Artificial Sequence
  Description of Artificial Sequence: Synthetic peptide
LYCSGGSCY

SEQ ID NO: 8205 - protein, 9 aa, Artificial Sequence
  Description of Artificial Sequence: Synthetic peptide
RYCSGGSCS

SEQ ID NO: 8206 - protein, 9 aa, Artificial Sequence
  Description of Artificial Sequence: Synthetic peptide
PYCSGGSCY

SEQ ID NO: 8207 - protein, 9 aa, Artificial Sequence
  Description of Artificial Sequence: Synthetic peptide
TYCSSTSCY

SEQ ID NO: 8208 - protein, 9 aa, Artificial Sequence
  Description of Artificial Sequence: Synthetic peptide
AYCSSTSCY

SEQ ID NO: 8209 - protein, 9 aa, Artificial Sequence
  Description of Artificial Sequence: Synthetic peptide
AYCSSTSCS

SEQ ID NO: 8210 - protein, 9 aa, Artificial Sequence
  Description of Artificial Sequence: Synthetic peptide
RYCSSTSCS

SEQ ID NO: 8211 - protein, 9 aa, Artificial Sequence
  Description of Artificial Sequence: Synthetic peptide
TYCSSTSCS

SEQ ID NO: 8212 - protein, 9 aa, Artificial Sequence
  Description of Artificial Sequence: Synthetic peptide
PYCSSTSCY

SEQ ID NO: 8213 - protein, 9 aa, Artificial Sequence
  Description of Artificial Sequence: Synthetic peptide
PYCSSTSCS

SEQ ID NO: 8214 - protein, 9 aa, Artificial Sequence
  Description of Artificial Sequence: Synthetic peptide
RYCSSTSCY

SEQ ID NO: 8215 - protein, 9 aa, Artificial Sequence
  Description of Artificial Sequence: Synthetic peptide
VYCSSTSCS

SEQ ID NO: 8216 - protein, 9 aa, Artificial Sequence
  Description of Artificial Sequence: Synthetic peptide
VYCSSTSCY

SEQ ID NO: 8217 - protein, 9 aa, Artificial Sequence
  Description of Artificial Sequence: Synthetic peptide
LYCSSTSCF

SEQ ID NO: 8218 - protein, 9 aa, Artificial Sequence
  Description of Artificial Sequence: Synthetic peptide
LYCSSTSCY

SEQ ID NO: 8219 - protein, 9 aa, Artificial Sequence
  Description of Artificial Sequence: Synthetic peptide
PYCSSTSCF

SEQ ID NO: 8220 - protein, 9 aa, Artificial Sequence
  Description of Artificial Sequence: Synthetic peptide
VYCSSTSCF

SEQ ID NO: 8221 - protein, 9 aa, Artificial Sequence
  Description of Artificial Sequence: Synthetic peptide
IYCSSTSCY

SEQ ID NO: 8222 - protein, 9 aa, Artificial Sequence
  Description of Artificial Sequence: Synthetic peptide
IYCSSTSCS

SEQ ID NO: 8223 - protein, 9 aa, Artificial Sequence
  Description of Artificial Sequence: Synthetic peptide
IYCSSTSCF

SEQ ID NO: 8224 - protein, 9 aa, Artificial Sequence
  Description of Artificial Sequence: Synthetic peptide
SYCSSTSCS

SEQ ID NO: 8225 - protein, 9 aa, Artificial Sequence
  Description of Artificial Sequence: Synthetic peptide
LYCSSTSCS

SEQ ID NO: 8226 - protein, 9 aa, Artificial Sequence
  Description of Artificial Sequence: Synthetic peptide
SYCSSTSCY

SEQ ID NO: 8227 - protein, 9 aa, Artificial Sequence
  Description of Artificial Sequence: Synthetic peptide
SYCSSTSCF

SEQ ID NO: 8228 - protein, 9 aa, Artificial Sequence
  Description of Artificial Sequence: Synthetic peptide
GYCSSTSCF

SEQ ID NO: 8229 - protein, 9 aa, Artificial Sequence
  Description of Artificial Sequence: Synthetic peptide
GYCSSTSCS

SEQ ID NO: 8230 - protein, 9 aa, Artificial Sequence
  Description of Artificial Sequence: Synthetic peptide
RYCSSTSCF

SEQ ID NO: 8231 - protein, 9 aa, Artificial Sequence
  Description of Artificial Sequence: Synthetic peptide
TYCSSTSCF

SEQ ID NO: 8232 - protein, 9 aa, Artificial Sequence
  Description of Artificial Sequence: Synthetic peptide
AYCSSTSCF

SEQ ID NO: 8233 - protein, 9 aa, Artificial Sequence
  Description of Artificial Sequence: Synthetic peptide
IYDFWSGYY

SEQ ID NO: 8234 - protein, 9 aa, Artificial Sequence
  Description of Artificial Sequence: Synthetic peptide
NYDFWSGYY

SEQ ID NO: 8235 - protein, 9 aa, Artificial Sequence
  Description of Artificial Sequence: Synthetic peptide
PYDFWSGYF

SEQ ID NO: 8236 - protein, 9 aa, Artificial Sequence
  Description of Artificial Sequence: Synthetic peptide
SYDFWSGYF

SEQ ID NO: 8237 - protein, 9 aa, Artificial Sequence
  Description of Artificial Sequence: Synthetic peptide
VYDFWSGYF

SEQ ID NO: 8238 - protein, 9 aa, Artificial Sequence
  Description of Artificial Sequence: Synthetic peptide
VYDFWSGYY

SEQ ID NO: 8239 - protein, 9 aa, Artificial Sequence
  Description of Artificial Sequence: Synthetic peptide
HYDFWSGYY

SEQ ID NO: 8240 - protein, 9 aa, Artificial Sequence
  Description of Artificial Sequence: Synthetic peptide
HYDFWSGYF

SEQ ID NO: 8241 - protein, 9 aa, Artificial Sequence
  Description of Artificial Sequence: Synthetic peptide
HYDFWSGYS

SEQ ID NO: 8242 - protein, 9 aa, Artificial Sequence
  Description of Artificial Sequence: Synthetic peptide
IYDFWSGYS

SEQ ID NO: 8243 - protein, 9 aa, Artificial Sequence
  Description of Artificial Sequence: Synthetic peptide
NYDFWSGYS

SEQ ID NO: 8244 - protein, 9 aa, Artificial Sequence
  Description of Artificial Sequence: Synthetic peptide
AYDFWSGYS

SEQ ID NO: 8245 - protein, 9 aa, Artificial Sequence
  Description of Artificial Sequence: Synthetic peptide
SYDFWSGYS

SEQ ID NO: 8246 - protein, 9 aa, Artificial Sequence
  Description of Artificial Sequence: Synthetic peptide
PYDFWSGYS

SEQ ID NO: 8247 - protein, 9 aa, Artificial Sequence
  Description of Artificial Sequence: Synthetic peptide
AYDFWSGYY

SEQ ID NO: 8248 - protein, 9 aa, Artificial Sequence
  Description of Artificial Sequence: Synthetic peptide
SYDFWSGYY

SEQ ID NO: 8249 - protein, 9 aa, Artificial Sequence
  Description of Artificial Sequence: Synthetic peptide
PYDFWSGYY

SEQ ID NO: 8250 - protein, 9 aa, Artificial Sequence
  Description of Artificial Sequence: Synthetic peptide
FYDFWSGYY

SEQ ID NO: 8251 - protein, 9 aa, Artificial Sequence
  Description of Artificial Sequence: Synthetic peptide
FYDFWSGYF

SEQ ID NO: 8252 - protein, 9 aa, Artificial Sequence
  Description of Artificial Sequence: Synthetic peptide
DYDFWSGYS

SEQ ID NO: 8253 - protein, 9 aa, Artificial Sequence
  Description of Artificial Sequence: Synthetic peptide
FYDFWSGYS

SEQ ID NO: 8254 - protein, 9 aa, Artificial Sequence
  Description of Artificial Sequence: Synthetic peptide
DYDFWSGYF

SEQ ID NO: 8255 - protein, 9 aa, Artificial Sequence
  Description of Artificial Sequence: Synthetic peptide
LYDFWSGYY

SEQ ID NO: 8256 - protein, 9 aa, Artificial Sequence
  Description of Artificial Sequence: Synthetic peptide
AYDFWSGYF

SEQ ID NO: 8257 - protein, 9 aa, Artificial Sequence
  Description of Artificial Sequence: Synthetic peptide
LYDFWSGYS

SEQ ID NO: 8258 - protein, 9 aa, Artificial Sequence
  Description of Artificial Sequence: Synthetic peptide
DYDFWSGYY

SEQ ID NO: 8259 - protein, 9 aa, Artificial Sequence
  Description of Artificial Sequence: Synthetic peptide
LYDFWSGYF

SEQ ID NO: 8260 - protein, 9 aa, Artificial Sequence
  Description of Artificial Sequence: Synthetic peptide
TYDFWSGYY

SEQ ID NO: 8261 - protein, 9 aa, Artificial Sequence
  Description of Artificial Sequence: Synthetic peptide
TYDFWSGYF

SEQ ID NO: 8262 - protein, 9 aa, Artificial Sequence
  Description of Artificial Sequence: Synthetic peptide
YYDFWSGYS

SEQ ID NO: 8263 - protein, 9 aa, Artificial Sequence
  Description of Artificial Sequence: Synthetic peptide
YYDFWSGYF

SEQ ID NO: 8264 - protein, 9 aa, Artificial Sequence
  Description of Artificial Sequence: Synthetic peptide
TYDFWSGYS

SEQ ID NO: 8265 - protein, 9 aa, Artificial Sequence
  Description of Artificial Sequence: Synthetic peptide
VYDFWSGYS

SEQ ID NO: 8266 - protein, 9 aa, Artificial Sequence
  Description of Artificial Sequence: Synthetic peptide
NYDFWSGYF

SEQ ID NO: 8267 - protein, 9 aa, Artificial Sequence
  Description of Artificial Sequence: Synthetic peptide
IYDFWSGYF

SEQ ID NO: 8268 - protein, 9 aa, Artificial Sequence
  Description of Artificial Sequence: Synthetic peptide
FCSGGSCYS

SEQ ID NO: 8269 - protein, 9 aa, Artificial Sequence
  Description of Artificial Sequence: Synthetic peptide
LCSGGSCYS

SEQ ID NO: 8270 - protein, 9 aa, Artificial Sequence
  Description of Artificial Sequence: Synthetic peptide
VCSGGSCYS

SEQ ID NO: 8271 - protein, 9 aa, Artificial Sequence
  Description of Artificial Sequence: Synthetic peptide
ACSGGSCYS

SEQ ID NO: 8272 - protein, 9 aa, Artificial Sequence
  Description of Artificial Sequence: Synthetic peptide
ACSGGSCYY

SEQ ID NO: 8273 - protein, 9 aa, Artificial Sequence
  Description of Artificial Sequence: Synthetic peptide
FCSGGSCYY

SEQ ID NO: 8274 - protein, 9 aa, Artificial Sequence
  Description of Artificial Sequence: Synthetic peptide
LCSGGSCYF

SEQ ID NO: 8275 - protein, 9 aa, Artificial Sequence
  Description of Artificial Sequence: Synthetic peptide
LCSGGSCYY

SEQ ID NO: 8276 - protein, 9 aa, Artificial Sequence
  Description of Artificial Sequence: Synthetic peptide
VCSGGSCYY

SEQ ID NO: 8277 - protein, 9 aa, Artificial Sequence
  Description of Artificial Sequence: Synthetic peptide
PCSGGSCYS

SEQ ID NO: 8278 - protein, 9 aa, Artificial Sequence
  Description of Artificial Sequence: Synthetic peptide
PCSGGSCYY

SEQ ID NO: 8279 - protein, 9 aa, Artificial Sequence
  Description of Artificial Sequence: Synthetic peptide
PCSGGSCYF

SEQ ID NO: 8280 - protein, 9 aa, Artificial Sequence
  Description of Artificial Sequence: Synthetic peptide
YCSGGSCYF

SEQ ID NO: 8281 - protein, 9 aa, Artificial Sequence
  Description of Artificial Sequence: Synthetic peptide
YCSGGSCYY

SEQ ID NO: 8282 - protein, 9 aa, Artificial Sequence
  Description of Artificial Sequence: Synthetic peptide
SCSGGSCYY

SEQ ID NO: 8283 - protein, 9 aa, Artificial Sequence
  Description of Artificial Sequence: Synthetic peptide
HCSGGSCYF

SEQ ID NO: 8284 - protein, 9 aa, Artificial Sequence
  Description of Artificial Sequence: Synthetic peptide
DCSGGSCYY

SEQ ID NO: 8285 - protein, 9 aa, Artificial Sequence
  Description of Artificial Sequence: Synthetic peptide
SCSGGSCYF

SEQ ID NO: 8286 - protein, 9 aa, Artificial Sequence
  Description of Artificial Sequence: Synthetic peptide
DCSGGSCYS

SEQ ID NO: 8287 - protein, 9 aa, Artificial Sequence
  Description of Artificial Sequence: Synthetic peptide
HCSGGSCYS

SEQ ID NO: 8288 - protein, 9 aa, Artificial Sequence
  Description of Artificial Sequence: Synthetic peptide
SCSGGSCYS

SEQ ID NO: 8289 - protein, 9 aa, Artificial Sequence
  Description of Artificial Sequence: Synthetic peptide
FCSGGSCYF

SEQ ID NO: 8290 - protein, 9 aa, Artificial Sequence
  Description of Artificial Sequence: Synthetic peptide
ACSGGSCYF

SEQ ID NO: 8291 - protein, 9 aa, Artificial Sequence
  Description of Artificial Sequence: Synthetic peptide
DCSGGSCYF

SEQ ID NO: 8292 - protein, 9 aa, Artificial Sequence
  Description of Artificial Sequence: Synthetic peptide
HCSGGSCYY

SEQ ID NO: 8293 - protein, 9 aa, Artificial Sequence
  Description of Artificial Sequence: Synthetic peptide
VCSGGSCYF

SEQ ID NO: 8294 - protein, 10 aa, Artificial Sequence
  Description of Artificial Sequence: Synthetic peptide
FYYDSSGYYY

SEQ ID NO: 8295 - protein, 10 aa, Artificial Sequence
  Description of Artificial Sequence: Synthetic peptide
YYYDSSGYYF

SEQ ID NO: 8296 - protein, 10 aa, Artificial Sequence
  Description of Artificial Sequence: Synthetic peptide
PYYDSSGYYY

SEQ ID NO: 8297 - protein, 10 aa, Artificial Sequence
  Description of Artificial Sequence: Synthetic peptide
VYYDSSGYYS

SEQ ID NO: 8298 - protein, 10 aa, Artificial Sequence
  Description of Artificial Sequence: Synthetic peptide
PYYDSSGYYS

SEQ ID NO: 8299 - protein, 10 aa, Artificial Sequence
  Description of Artificial Sequence: Synthetic peptide
FYYDSSGYYS

SEQ ID NO: 8300 - protein, 10 aa, Artificial Sequence
  Description of Artificial Sequence: Synthetic peptide
NYYDSSGYYY

SEQ ID NO: 8301 - protein, 10 aa, Artificial Sequence
  Description of Artificial Sequence: Synthetic peptide
NYYDSSGYYS

SEQ ID NO: 8302 - protein, 10 aa, Artificial Sequence
  Description of Artificial Sequence: Synthetic peptide
DYYDSSGYYS

SEQ ID NO: 8303 - protein, 10 aa, Artificial Sequence
  Description of Artificial Sequence: Synthetic peptide
HYYDSSGYYF

SEQ ID NO: 8304 - protein, 10 aa, Artificial Sequence
  Description of Artificial Sequence: Synthetic peptide
DYYDSSGYYY

SEQ ID NO: 8305 - protein, 10 aa, Artificial Sequence
  Description of Artificial Sequence: Synthetic peptide
NYYDSSGYYF

SEQ ID NO: 8306 - protein, 10 aa, Artificial Sequence
  Description of Artificial Sequence: Synthetic peptide
HYYDSSGYYY

SEQ ID NO: 8307 - protein, 10 aa, Artificial Sequence
  Description of Artificial Sequence: Synthetic peptide
LYYDSSGYYF

SEQ ID NO: 8308 - protein, 10 aa, Artificial Sequence
  Description of Artificial Sequence: Synthetic peptide
IYYDSSGYYS

SEQ ID NO: 8309 - protein, 10 aa, Artificial Sequence
  Description of Artificial Sequence: Synthetic peptide
YYYDSSGYYS

SEQ ID NO: 8310 - protein, 10 aa, Artificial Sequence
  Description of Artificial Sequence: Synthetic peptide
IYYDSSGYYF

SEQ ID NO: 8311 - protein, 10 aa, Artificial Sequence
  Description of Artificial Sequence: Synthetic peptide
HYYDSSGYYS

SEQ ID NO: 8312 - protein, 10 aa, Artificial Sequence
  Description of Artificial Sequence: Synthetic peptide
TYYDSSGYYS

SEQ ID NO: 8313 - protein, 10 aa, Artificial Sequence
  Description of Artificial Sequence: Synthetic peptide
IYYDSSGYYY

SEQ ID NO: 8314 - protein, 10 aa, Artificial Sequence
  Description of Artificial Sequence: Synthetic peptide
TYYDSSGYYF

SEQ ID NO: 8315 - protein, 10 aa, Artificial Sequence
  Description of Artificial Sequence: Synthetic peptide
LYYDSSGYYS

SEQ ID NO: 8316 - protein, 10 aa, Artificial Sequence
  Description of Artificial Sequence: Synthetic peptide
TYYDSSGYYY

SEQ ID NO: 8317 - protein, 10 aa, Artificial Sequence
  Description of Artificial Sequence: Synthetic peptide
LYYDSSGYYY

SEQ ID NO: 8318 - protein, 10 aa, Artificial Sequence
  Description of Artificial Sequence: Synthetic peptide
AYYDSSGYYF

SEQ ID NO: 8319 - protein, 10 aa, Artificial Sequence
  Description of Artificial Sequence: Synthetic peptide
FYYDSSGYYF

SEQ ID NO: 8320 - protein, 10 aa, Artificial Sequence
  Description of Artificial Sequence: Synthetic peptide
AYYDSSGYYY

SEQ ID NO: 8321 - protein, 10 aa, Artificial Sequence
  Description of Artificial Sequence: Synthetic peptide
VYYDSSGYYY

SEQ ID NO: 8322 - protein, 10 aa, Artificial Sequence
  Description of Artificial Sequence: Synthetic peptide
SYYDSSGYYF

SEQ ID NO: 8323 - protein, 10 aa, Artificial Sequence
  Description of Artificial Sequence: Synthetic peptide
PYYDSSGYYF

SEQ ID NO: 8324 - protein, 10 aa, Artificial Sequence
  Description of Artificial Sequence: Synthetic peptide
SYYDSSGYYY

SEQ ID NO: 8325 - protein, 10 aa, Artificial Sequence
  Description of Artificial Sequence: Synthetic peptide
AYYDSSGYYS

SEQ ID NO: 8326 - protein, 10 aa, Artificial Sequence
  Description of Artificial Sequence: Synthetic peptide
DYYDSSGYYF

SEQ ID NO: 8327 - protein, 10 aa, Artificial Sequence
  Description of Artificial Sequence: Synthetic peptide
SYYDSSGYYS

SEQ ID NO: 8328 - protein, 10 aa, Artificial Sequence
  Description of Artificial Sequence: Synthetic peptide
VYYDSSGYYF

SEQ ID NO: 8329 - protein, 11 aa, Artificial Sequence
  Description of Artificial Sequence: Synthetic peptide
IYDYVWGSYAS

SEQ ID NO: 8330 - protein, 11 aa, Artificial Sequence
  Description of Artificial Sequence: Synthetic peptide
AYDYVWGSYAS

SEQ ID NO: 8331 - protein, 11 aa, Artificial Sequence
  Description of Artificial Sequence: Synthetic peptide
IYDYVWGSYAY

SEQ ID NO: 8332 - protein, 11 aa, Artificial Sequence
  Description of Artificial Sequence: Synthetic peptide
NYDYVWGSYAY

SEQ ID NO: 8333 - protein, 11 aa, Artificial Sequence
  Description of Artificial Sequence: Synthetic peptide
NYDYVWGSYAS

SEQ ID NO: 8334 - protein, 11 aa, Artificial Sequence
  Description of Artificial Sequence: Synthetic peptide
YYDYVWGSYAF

SEQ ID NO: 8335 - protein, 11 aa, Artificial Sequence
  Description of Artificial Sequence: Synthetic peptide
DYDYVWGSYAF

SEQ ID NO: 8336 - protein, 11 aa, Artificial Sequence
  Description of Artificial Sequence: Synthetic peptide
SYDYVWGSYAY

SEQ ID NO: 8337 - protein, 11 aa, Artificial Sequence
  Description of Artificial Sequence: Synthetic peptide
DYDYVWGSYAS

SEQ ID NO: 8338 - protein, 11 aa, Artificial Sequence
  Description of Artificial Sequence: Synthetic peptide
DYDYVWGSYAY

SEQ ID NO: 8339 - protein, 11 aa, Artificial Sequence
  Description of Artificial Sequence: Synthetic peptide
FYDYVWGSYAS

SEQ ID NO: 8340 - protein, 11 aa, Artificial Sequence
  Description of Artificial Sequence: Synthetic peptide
NYDYVWGSYAF

SEQ ID NO: 8341 - protein, 11 aa, Artificial Sequence
  Description of Artificial Sequence: Synthetic peptide
YYDYVWGSYAS

SEQ ID NO: 8342 - protein, 11 aa, Artificial Sequence
  Description of Artificial Sequence: Synthetic peptide
FYDYVWGSYAY

SEQ ID NO: 8343 - protein, 11 aa, Artificial Sequence
  Description of Artificial Sequence: Synthetic peptide
SYDYVWGSYAS

SEQ ID NO: 8344 - protein, 11 aa, Artificial Sequence
  Description of Artificial Sequence: Synthetic peptide
PYDYVWGSYAF

SEQ ID NO: 8345 - protein, 11 aa, Artificial Sequence
  Description of Artificial Sequence: Synthetic peptide
TYDYVWGSYAY

SEQ ID NO: 8346 - protein, 11 aa, Artificial Sequence
  Description of Artificial Sequence: Synthetic peptide
VYDYVWGSYAY

SEQ ID NO: 8347 - protein, 11 aa, Artificial Sequence
  Description of Artificial Sequence: Synthetic peptide
SYDYVWGSYAF

SEQ ID NO: 8348 - protein, 11 aa, Artificial Sequence
  Description of Artificial Sequence: Synthetic peptide
FYDYVWGSYAF

SEQ ID NO: 8349 - protein, 11 aa, Artificial Sequence
  Description of Artificial Sequence: Synthetic peptide
HYDYVWGSYAS

SEQ ID NO: 8350 - protein, 11 aa, Artificial Sequence
  Description of Artificial Sequence: Synthetic peptide
VYDYVWGSYAS

SEQ ID NO: 8351 - protein, 11 aa, Artificial Sequence
  Description of Artificial Sequence: Synthetic peptide
VYDYVWGSYAF

SEQ ID NO: 8352 - protein, 11 aa, Artificial Sequence
  Description of Artificial Sequence: Synthetic peptide
AYDYVWGSYAY

SEQ ID NO: 8353 - protein, 11 aa, Artificial Sequence
  Description of Artificial Sequence: Synthetic peptide
LYDYVWGSYAS

SEQ ID NO: 8354 - protein, 11 aa, Artificial Sequence
  Description of Artificial Sequence: Synthetic peptide
TYDYVWGSYAF

SEQ ID NO: 8355 - protein, 11 aa, Artificial Sequence
  Description of Artificial Sequence: Synthetic peptide
AYDYVWGSYAF

SEQ ID NO: 8356 - protein, 11 aa, Artificial Sequence
  Description of Artificial Sequence: Synthetic peptide
HYDYVWGSYAY

SEQ ID NO: 8357 - protein, 11 aa, Artificial Sequence
  Description of Artificial Sequence: Synthetic peptide
TYDYVWGSYAS

SEQ ID NO: 8358 - protein, 11 aa, Artificial Sequence
  Description of Artificial Sequence: Synthetic peptide
LYDYVWGSYAF

SEQ ID NO: 8359 - protein, 11 aa, Artificial Sequence
  Description of Artificial Sequence: Synthetic peptide
PYDYVWGSYAY

SEQ ID NO: 8360 - protein, 11 aa, Artificial Sequence
  Description of Artificial Sequence: Synthetic peptide
PYDYVWGSYAS

SEQ ID NO: 8361 - protein, 11 aa, Artificial Sequence
  Description of Artificial Sequence: Synthetic peptide
HYDYVWGSYAF

SEQ ID NO: 8362 - protein, 11 aa, Artificial Sequence
  Description of Artificial Sequence: Synthetic peptide
LYDYVWGSYAY

SEQ ID NO: 8363 - protein, 11 aa, Artificial Sequence
  Description of Artificial Sequence: Synthetic peptide
IYDYVWGSYAF

SEQ ID NO: 8364 - protein, 12 aa, Artificial Sequence
  Description of Artificial Sequence: Synthetic peptide
NYDYVWGSYAYT

SEQ ID NO: 8365 - protein, 12 aa, Artificial Sequence
  Description of Artificial Sequence: Synthetic peptide
NYDYVWGSYAYI

SEQ ID NO: 8366 - protein, 12 aa, Artificial Sequence
  Description of Artificial Sequence: Synthetic peptide
IYDYVWGSYAYI

SEQ ID NO: 8367 - protein, 12 aa, Artificial Sequence
  Description of Artificial Sequence: Synthetic peptide
YYDYVWGSYAYK

SEQ ID NO: 8368 - protein, 12 aa, Artificial Sequence
  Description of Artificial Sequence: Synthetic peptide
NYDYVWGSYAYK

SEQ ID NO: 8369 - protein, 12 aa, Artificial Sequence
  Description of Artificial Sequence: Synthetic peptide
PYDYVWGSYAYT

SEQ ID NO: 8370 - protein, 12 aa, Artificial Sequence
  Description of Artificial Sequence: Synthetic peptide
DYDYVWGSYAYI

SEQ ID NO: 8371 - protein, 12 aa, Artificial Sequence
  Description of Artificial Sequence: Synthetic peptide
PYDYVWGSYAYK

SEQ ID NO: 8372 - protein, 12 aa, Artificial Sequence
  Description of Artificial Sequence: Synthetic peptide
FYDYVWGSYAYI

SEQ ID NO: 8373 - protein, 12 aa, Artificial Sequence
  Description of Artificial Sequence: Synthetic peptide
VYDYVWGSYAYT

SEQ ID NO: 8374 - protein, 12 aa, Artificial Sequence
  Description of Artificial Sequence: Synthetic peptide
DYDYVWGSYAYK

SEQ ID NO: 8375 - protein, 12 aa, Artificial Sequence
  Description of Artificial Sequence: Synthetic peptide
IYDYVWGSYAYT

SEQ ID NO: 8376 - protein, 12 aa, Artificial Sequence
  Description of Artificial Sequence: Synthetic peptide
IYDYVWGSYAYK

SEQ ID NO: 8377 - protein, 12 aa, Artificial Sequence
  Description of Artificial Sequence: Synthetic peptide
LYDYVWGSYAYI

SEQ ID NO: 8378 - protein, 12 aa, Artificial Sequence
  Description of Artificial Sequence: Synthetic peptide
HYDYVWGSYAYK

SEQ ID NO: 8379 - protein, 12 aa, Artificial Sequence
  Description of Artificial Sequence: Synthetic peptide
TYDYVWGSYAYI

SEQ ID NO: 8380 - protein, 12 aa, Artificial Sequence
  Description of Artificial Sequence: Synthetic peptide
HYDYVWGSYAYT

SEQ ID NO: 8381 - protein, 12 aa, Artificial Sequence
  Description of Artificial Sequence: Synthetic peptide
AYDYVWGSYAYT

SEQ ID NO: 8382 - protein, 12 aa, Artificial Sequence
  Description of Artificial Sequence: Synthetic peptide
AYDYVWGSYAYK

SEQ ID NO: 8383 - protein, 12 aa, Artificial Sequence
  Description of Artificial Sequence: Synthetic peptide
AYDYVWGSYAYI

SEQ ID NO: 8384 - protein, 12 aa, Artificial Sequence
  Description of Artificial Sequence: Synthetic peptide
TYDYVWGSYAYK

SEQ ID NO: 8385 - protein, 12 aa, Artificial Sequence
  Description of Artificial Sequence: Synthetic peptide
DYDYVWGSYAYT

SEQ ID NO: 8386 - protein, 12 aa, Artificial Sequence
  Description of Artificial Sequence: Synthetic peptide
VYDYVWGSYAYK

SEQ ID NO: 8387 - protein, 12 aa, Artificial Sequence
  Description of Artificial Sequence: Synthetic peptide
TYDYVWGSYAYT

SEQ ID NO: 8388 - protein, 12 aa, Artificial Sequence
  Description of Artificial Sequence: Synthetic peptide
FYDYVWGSYAYK

SEQ ID NO: 8389 - protein, 12 aa, Artificial Sequence
  Description of Artificial Sequence: Synthetic peptide
LYDYVWGSYAYK

SEQ ID NO: 8390 - protein, 12 aa, Artificial Sequence
  Description of Artificial Sequence: Synthetic peptide
VYDYVWGSYAYI

SEQ ID NO: 8391 - protein, 12 aa, Artificial Sequence
  Description of Artificial Sequence: Synthetic peptide
LYDYVWGSYAYT

SEQ ID NO: 8392 - protein, 12 aa, Artificial Sequence
  Description of Artificial Sequence: Synthetic peptide
PYDYVWGSYAYI

SEQ ID NO: 8393 - protein, 12 aa, Artificial Sequence
  Description of Artificial Sequence: Synthetic peptide
FYDYVWGSYAYT

SEQ ID NO: 8394 - protein, 12 aa, Artificial Sequence
  Description of Artificial Sequence: Synthetic peptide
YYDYVWGSYAYI

SEQ ID NO: 8395 - protein, 12 aa, Artificial Sequence
  Description of Artificial Sequence: Synthetic peptide
SYDYVWGSYAYI

SEQ ID NO: 8396 - protein, 12 aa, Artificial Sequence
  Description of Artificial Sequence: Synthetic peptide
HYDYVWGSYAYI

SEQ ID NO: 8397 - protein, 12 aa, Artificial Sequence
  Description of Artificial Sequence: Synthetic peptide
SYDYVWGSYAYT

SEQ ID NO: 8398 - protein, 12 aa, Artificial Sequence
  Description of Artificial Sequence: Synthetic peptide
SYDYVWGSYAYK

SEQ ID NO: 8399 - DNA, 12 bp, Artificial Sequence
  Description of Artificial Sequence: Synthetic oligonucleotide
ggabhcggatac

SEQ ID NO: 8400 - DNA, 12 bp, Artificial Sequence
  Description of Artificial Sequence: Synthetic oligonucleotide
agabhcggatac

SEQ ID NO: 8401 - DNA, 12 bp, Artificial Sequence
  Description of Artificial Sequence: Synthetic oligonucleotide
agcbhcggatac

SEQ ID NO: 8402 - DNA, 12 bp, Artificial Sequence
  Description of Artificial Sequence: Synthetic oligonucleotide
ccabhcggatac

SEQ ID NO: 8403 - DNA, 12 bp, Artificial Sequence
  Description of Artificial Sequence: Synthetic oligonucleotide
ggtagavhgtac

SEQ ID NO: 8404 - DNA, 12 bp, Artificial Sequence
  Description of Artificial Sequence: Synthetic oligonucleotide
aggagavhgtac

SEQ ID NO: 8405 - DNA, 12 bp, Artificial Sequence
  Description of Artificial Sequence: Synthetic oligonucleotide
ggabhcggatgg

SEQ ID NO: 8406 - DNA, 12 bp, Artificial Sequence
  Description of Artificial Sequence: Synthetic oligonucleotide
ggabhcggacta

SEQ ID NO: 8407 - DNA, 12 bp, Artificial Sequence
  Description of Artificial Sequence: Synthetic oligonucleotide
ggabhcacagct

SEQ ID NO: 8408 - DNA, 12 bp, Artificial Sequence
  Description of Artificial Sequence: Synthetic oligonucleotide
ggabhcacacaa

SEQ ID NO: 8409 - protein, 4 aa, Artificial Sequence
  Description of Artificial Sequence: Synthetic peptide
RPGY

SEQ ID NO: 8410 - protein, 4 aa, Artificial Sequence
  Description of Artificial Sequence: Synthetic peptide
RFGY

SEQ ID NO: 8411 - protein, 4 aa, Artificial Sequence
  Description of Artificial Sequence: Synthetic peptide
RLGY

SEQ ID NO: 8412 - protein, 4 aa, Artificial Sequence
  Description of Artificial Sequence: Synthetic peptide
GREY

SEQ ID NO: 8413 - protein, 4 aa, Artificial Sequence
  Description of Artificial Sequence: Synthetic peptide
GRKY

SEQ ID NO: 8414 - protein, 4 aa, Artificial Sequence
  Description of Artificial Sequence: Synthetic peptide
GHGW

SEQ ID NO: 8415 - protein, 4 aa, Artificial Sequence
  Description of Artificial Sequence: Synthetic peptide
RVGY

SEQ ID NO: 8416 - protein, 4 aa, Artificial Sequence
  Description of Artificial Sequence: Synthetic peptide
GLGL

SEQ ID NO: 8417 - protein, 4 aa, Artificial Sequence
  Description of Artificial Sequence: Synthetic peptide
GHGY

SEQ ID NO: 8418 - protein, 4 aa, Artificial Sequence
  Description of Artificial Sequence: Synthetic peptide
RRVY

SEQ ID NO: 8419 - protein, 4 aa, Artificial Sequence
  Description of Artificial Sequence: Synthetic peptide
GLGW

SEQ ID NO: 8420 - protein, 4 aa, Artificial Sequence
  Description of Artificial Sequence: Synthetic peptide
GHGL

SEQ ID NO: 8421 - protein, 4 aa, Artificial Sequence
  Description of Artificial Sequence: Synthetic peptide
GLGY

SEQ ID NO: 8422 - protein, 4 aa, Artificial Sequence
  Description of Artificial Sequence: Synthetic peptide
PVGY

SEQ ID NO: 8423 - protein, 4 aa, Artificial Sequence
  Description of Artificial Sequence: Synthetic peptide
GPGY

SEQ ID NO: 8424 - protein, 4 aa, Artificial Sequence
  Description of Artificial Sequence: Synthetic peptide
GPGW

SEQ ID NO: 8425 - protein, 4 aa, Artificial Sequence
  Description of Artificial Sequence: Synthetic peptide
GPGL

SEQ ID NO: 8426 - protein, 4 aa, Artificial Sequence
  Description of Artificial Sequence: Synthetic peptide
GVTA

SEQ ID NO: 8427 - protein, 4 aa, Artificial Sequence
  Description of Artificial Sequence: Synthetic peptide
GRLY

SEQ ID NO: 8428 - protein, 4 aa, Artificial Sequence
  Description of Artificial Sequence: Synthetic peptide
RRAY

SEQ ID NO: 8429 - protein, 4 aa, Artificial Sequence
  Description of Artificial Sequence: Synthetic peptide
GHTQ

SEQ ID NO: 8430 - protein, 4 aa, Artificial Sequence
  Description of Artificial Sequence: Synthetic peptide
GVGL

SEQ ID NO: 8431 - protein, 4 aa, Artificial Sequence
  Description of Artificial Sequence: Synthetic peptide
RRQY

SEQ ID NO: 8432 - protein, 4 aa, Artificial Sequence
  Description of Artificial Sequence: Synthetic peptide
GATQ

SEQ ID NO: 8433 - protein, 4 aa, Artificial Sequence
  Description of Artificial Sequence: Synthetic peptide
PFGY

SEQ ID NO: 8434 - protein, 4 aa, Artificial Sequence
  Description of Artificial Sequence: Synthetic peptide
GVGY

SEQ ID NO: 8435 - protein, 4 aa, Artificial Sequence
  Description of Artificial Sequence: Synthetic peptide
GVGW

SEQ ID NO: 8436 - protein, 4 aa, Artificial Sequence
  Description of Artificial Sequence: Synthetic peptide
GATA

SEQ ID NO: 8437 - protein, 4 aa, Artificial Sequence
  Description of Artificial Sequence: Synthetic peptide
GRAY

SEQ ID NO: 8438 - protein, 4 aa, Artificial Sequence
  Description of Artificial Sequence: Synthetic peptide
GRMY

SEQ ID NO: 8439 - protein, 4 aa, Artificial Sequence
  Description of Artificial Sequence: Synthetic peptide
GRTY

SEQ ID NO: 8440 - protein, 4 aa, Artificial Sequence
  Description of Artificial Sequence: Synthetic peptide
PPGY

SEQ ID NO: 8441 - protein, 4 aa, Artificial Sequence
  Description of Artificial Sequence: Synthetic peptide
RRPY

SEQ ID NO: 8442 - protein, 4 aa, Artificial Sequence
  Description of Artificial Sequence: Synthetic peptide
RHGY

SEQ ID NO: 8443 - protein, 4 aa, Artificial Sequence
  Description of Artificial Sequence: Synthetic peptide
SVGY

SEQ ID NO: 8444 - protein, 4 aa, Artificial Sequence
  Description of Artificial Sequence: Synthetic peptide
GVTQ

SEQ ID NO: 8445 - protein, 4 aa, Artificial Sequence
  Description of Artificial Sequence: Synthetic peptide
GDGW

SEQ ID NO: 8446 - protein, 4 aa, Artificial Sequence
  Description of Artificial Sequence: Synthetic peptide
GRQY

SEQ ID NO: 8447 - protein, 4 aa, Artificial Sequence
  Description of Artificial Sequence: Synthetic peptide
GDGL

SEQ ID NO: 8448 - protein, 4 aa, Artificial Sequence
  Description of Artificial Sequence: Synthetic peptide
SHGY

SEQ ID NO: 8449 - protein, 4 aa, Artificial Sequence
  Description of Artificial Sequence: Synthetic peptide
GFGY

SEQ ID NO: 8450 - protein, 4 aa, Artificial Sequence
  Description of Artificial Sequence: Synthetic peptide
GFGW

SEQ ID NO: 8451 - protein, 4 aa, Artificial Sequence
  Description of Artificial Sequence: Synthetic peptide
GSGW

SEQ ID NO: 8452 - protein, 4 aa, Artificial Sequence
  Description of Artificial Sequence: Synthetic peptide
GFGL

SEQ ID NO: 8453 - protein, 4 aa, Artificial Sequence
  Description of Artificial Sequence: Synthetic peptide
GSGL

SEQ ID NO: 8454 - protein, 4 aa, Artificial Sequence
  Description of Artificial Sequence: Synthetic peptide
RRLY

SEQ ID NO: 8455 - protein, 4 aa, Artificial Sequence
  Description of Artificial Sequence: Synthetic peptide
GFTA

SEQ ID NO: 8456 - protein, 4 aa, Artificial Sequence
  Description of Artificial Sequence: Synthetic peptide
PLGY

SEQ ID NO: 8457 - protein, 4 aa, Artificial Sequence
  Description of Artificial Sequence: Synthetic peptide
GYTQ

SEQ ID NO: 8458 - protein, 4 aa, Artificial Sequence
  Description of Artificial Sequence: Synthetic peptide
GLTQ

SEQ ID NO: 8459 - protein, 4 aa, Artificial Sequence
  Description of Artificial Sequence: Synthetic peptide
GHTA

SEQ ID NO: 8460 - protein, 4 aa, Artificial Sequence
  Description of Artificial Sequence: Synthetic peptide
PHGY

SEQ ID NO: 8461 - protein, 4 aa, Artificial Sequence
  Description of Artificial Sequence: Synthetic peptide
GFTQ

SEQ ID NO: 8462 - protein, 4 aa, Artificial Sequence
  Description of Artificial Sequence: Synthetic peptide
GRVY

SEQ ID NO: 8463 - protein, 4 aa, Artificial Sequence
  Description of Artificial Sequence: Synthetic peptide
GYTA

SEQ ID NO: 8464 - protein, 4 aa, Artificial Sequence
  Description of Artificial Sequence: Synthetic peptide
GLTA

SEQ ID NO: 8465 - protein, 4 aa, Artificial Sequence
  Description of Artificial Sequence: Synthetic peptide
RRKY

SEQ ID NO: 8466 - protein, 4 aa, Artificial Sequence
  Description of Artificial Sequence: Synthetic peptide
GPTQ

SEQ ID NO: 8467 - protein, 4 aa, Artificial Sequence
  Description of Artificial Sequence: Synthetic peptide
GPTA

SEQ ID NO: 8468 - protein, 4 aa, Artificial Sequence
  Description of Artificial Sequence: Synthetic peptide
GDTQ

SEQ ID NO: 8469 - protein, 4 aa, Artificial Sequence
  Description of Artificial Sequence: Synthetic peptide
GAGW

SEQ ID NO: 8470 - protein, 4 aa, Artificial Sequence
  Description of Artificial Sequence: Synthetic peptide
GDTA

SEQ ID NO: 8471 - protein, 4 aa, Artificial Sequence
  Description of Artificial Sequence: Synthetic peptide
SFGY

SEQ ID NO: 8472 - protein, 4 aa, Artificial Sequence
  Description of Artificial Sequence: Synthetic peptide
GAGL

SEQ ID NO: 8473 - protein, 4 aa, Artificial Sequence
  Description of Artificial Sequence: Synthetic peptide
GSTQ

SEQ ID NO: 8474 - protein, 4 aa, Artificial Sequence
  Description of Artificial Sequence: Synthetic peptide
GRPY

SEQ ID NO: 8475 - protein, 4 aa, Artificial Sequence
  Description of Artificial Sequence: Synthetic peptide
SLGY

SEQ ID NO: 8476 - protein, 4 aa, Artificial Sequence
  Description of Artificial Sequence: Synthetic peptide
GSTA

SEQ ID NO: 8477 - protein, 4 aa, Artificial Sequence
  Description of Artificial Sequence: Synthetic peptide
GYGL

SEQ ID NO: 8478 - protein, 4 aa, Artificial Sequence
  Description of Artificial Sequence: Synthetic peptide
RREY

SEQ ID NO: 8479 - protein, 4 aa, Artificial Sequence
  Description of Artificial Sequence: Synthetic peptide
SPGY

SEQ ID NO: 8480 - protein, 4 aa, Artificial Sequence
  Description of Artificial Sequence: Synthetic peptide
RRTY

SEQ ID NO: 8481 - protein, 4 aa, Artificial Sequence
  Description of Artificial Sequence: Synthetic peptide
GYGW

SEQ ID NO: 8482 - protein, 4 aa, Artificial Sequence
  Description of Artificial Sequence: Synthetic peptide
RRMY

SEQ ID NO: 8483 - DNA, 33 bp, Artificial Sequence
  Description of Artificial Sequence: Synthetic oligonucleotide
tggggacagggtacattggtcaccgtctcctca

SEQ ID NO: 8484 - DNA, 36 bp, Artificial Sequence
  Description of Artificial Sequence: Synthetic oligonucleotide
cattggggacagggtacattggtcaccgtctcctca

SEQ ID NO: 8485 - DNA, 36 bp, Artificial Sequence
  Description of Artificial Sequence: Synthetic oligonucleotide
atttggggacagggtacattggtcaccgtctcctca

SEQ ID NO: 8486 - DNA, 36 bp, Artificial Sequence
  Description of Artificial Sequence: Synthetic oligonucleotide
tactggggacagggtacattggtcaccgtctcctca

SEQ ID NO: 8487 - DNA, 36 bp, Artificial Sequence
  Description of Artificial Sequence: Synthetic oligonucleotide
ccatggggacagggtacattggtcaccgtctcctca

SEQ ID NO: 8488 - DNA, 36 bp, Artificial Sequence
  Description of Artificial Sequence: Synthetic oligonucleotide
gtctggggacagggtacattggtcaccgtctcctca

SEQ ID NO: 8489 - DNA, 36 bp, Artificial Sequence
  Description of Artificial Sequence: Synthetic oligonucleotide
gattggggacagggtacattggtcaccgtctcctca

SEQ ID NO: 8490 - DNA, 36 bp, Artificial Sequence
  Description of Artificial Sequence: Synthetic oligonucleotide
ttctggggacagggtacattggtcaccgtctcctca

SEQ ID NO: 8491 - DNA, 36 bp, Artificial Sequence
  Description of Artificial Sequence: Synthetic oligonucleotide
aattggggacagggtacattggtcaccgtctcctca

SEQ ID NO: 8492 - DNA, 36 bp, Artificial Sequence
  Description of Artificial Sequence: Synthetic oligonucleotide
agttggggacagggtacattggtcaccgtctcctca

SEQ ID NO: 8493 - DNA, 36 bp, Artificial Sequence
  Description of Artificial Sequence: Synthetic oligonucleotide
acttggggacagggtacattggtcaccgtctcctca

SEQ ID NO: 8494 - DNA, 36 bp, Artificial Sequence
  Description of Artificial Sequence: Synthetic oligonucleotide
gcatggggacagggtacattggtcaccgtctcctca

SEQ ID NO: 8495 - DNA, 39 bp, Artificial Sequence
  Description of Artificial Sequence: Synthetic oligonucleotide
gattactggggacagggtacattggtcaccgtctcctca

SEQ ID NO: 8496 - DNA, 39 bp, Artificial Sequence
  Description of Artificial Sequence: Synthetic oligonucleotide
gcttactggggacagggtacattggtcaccgtctcctca

SEQ ID NO: 8497 - DNA, 39 bp, Artificial Sequence
  Description of Artificial Sequence: Synthetic oligonucleotide
ttctactggggacagggtacattggtcaccgtctcctca

SEQ ID NO: 8498 - DNA, 39 bp, Artificial Sequence
  Description of Artificial Sequence: Synthetic oligonucleotide
ggctattggggacagggtacattggtcaccgtctcctca

SEQ ID NO: 8499 - DNA, 39 bp, Artificial Sequence
  Description of Artificial Sequence: Synthetic oligonucleotide
cattactggggacagggtacattggtcaccgtctcctca

SEQ ID NO: 8500 - DNA, 39 bp, Artificial Sequence
  Description of Artificial Sequence: Synthetic oligonucleotide
agttactggggacagggtacattggtcaccgtctcctca

SEQ ID NO: 8501 - DNA, 39 bp, Artificial Sequence
  Description of Artificial Sequence: Synthetic oligonucleotide
gtttattggggacagggtacattggtcaccgtctcctca

SEQ ID NO: 8502 - DNA, 39 bp, Artificial Sequence
  Description of Artificial Sequence: Synthetic oligonucleotide
tactattggggacagggtacattggtcaccgtctcctca

SEQ ID NO: 8503 - DNA, 39 bp, Artificial Sequence
  Description of Artificial Sequence: Synthetic oligonucleotide
csatactggggacagggtacattggtcaccgtctcctca

SEQ ID NO: 8504 - DNA, 39 bp, Artificial Sequence
  Description of Artificial Sequence: Synthetic oligonucleotide
racatatggggtcagggtacaatggtcaccgtctcctca

SEQ ID NO: 8505 - DNA, 39 bp, Artificial Sequence
  Description of Artificial Sequence: Synthetic oligonucleotide
racccatggggacagggtacattggtcaccgtctcctca

SEQ ID NO: 8506 - DNA, 39 bp, Artificial Sequence
  Description of Artificial Sequence: Synthetic oligonucleotide
racgtatggggtcagggtacaatggtcaccgtctcctca

SEQ ID NO: 8507 - DNA, 39 bp, Artificial Sequence
  Description of Artificial Sequence: Synthetic oligonucleotide
amctactggggacagggtacattggtcaccgtctcctca

SEQ ID NO: 8508 - DNA, 39 bp, Artificial Sequence
  Description of Artificial Sequence: Synthetic oligonucleotide
mtatactggggacagggtacattggtcaccgtctcctca

SEQ ID NO: 8509 - DNA, 42 bp, Artificial Sequence
  Description of Artificial Sequence: Synthetic oligonucleotide
ttcgattattggggacagggtacattggtcaccgtctcctca

SEQ ID NO: 8510 - DNA, 42 bp, Artificial Sequence
  Description of Artificial Sequence: Synthetic oligonucleotide
attgactactggggacagggtacattggtcaccgtctcctca

SEQ ID NO: 8511 - DNA, 42 bp, Artificial Sequence
  Description of Artificial Sequence: Synthetic oligonucleotide
gtggactactggggacagggtacattggtcaccgtctcctca

SEQ ID NO: 8512 - DNA, 42 bp, Artificial Sequence
  Description of Artificial Sequence: Synthetic oligonucleotide
ttagattactggggacagggtacattggtcaccgtctcctca

SEQ ID NO: 8513 - DNA, 42 bp, Artificial Sequence
  Description of Artificial Sequence: Synthetic oligonucleotide
tccgattattggggacagggtacattggtcaccgtctcctca

SEQ ID NO: 8514 - DNA, 42 bp, Artificial Sequence
  Description of Artificial Sequence: Synthetic oligonucleotide
cacgattactggggacagggtacattggtcaccgtctcctca

SEQ ID NO: 8515 - DNA, 42 bp, Artificial Sequence
  Description of Artificial Sequence: Synthetic oligonucleotide
agagactactggggacagggtacattggtcaccgtctcctca

SEQ ID NO: 8516 - DNA, 42 bp, Artificial Sequence
  Description of Artificial Sequence: Synthetic oligonucleotide
ccagattactggggacagggtacattggtcaccgtctcctca

SEQ ID NO: 8517 - DNA, 42 bp, Artificial Sequence
  Description of Artificial Sequence: Synthetic oligonucleotide
aacgattactggggacagggtacattggtcaccgtctcctca

SEQ ID NO: 8518 - DNA, 42 bp, Artificial Sequence
  Description of Artificial Sequence: Synthetic oligonucleotide
actgattactggggacagggtacattggtcaccgtctcctca

SEQ ID NO: 8519 - DNA, 42 bp, Artificial Sequence
  Description of Artificial Sequence: Synthetic oligonucleotide
gatgattattggggacagggtacattggtcaccgtctcctca

SEQ ID NO: 8520 - DNA, 42 bp, Artificial Sequence
  Description of Artificial Sequence: Synthetic oligonucleotide
ggtgattattggggacagggtacattggtcaccgtctcctca

SEQ ID NO: 8521 - DNA, 42 bp, Artificial Sequence
  Description of Artificial Sequence: Synthetic oligonucleotide
gcagactactggggacagggtacattggtcaccgtctcctca

SEQ ID NO: 8522 - DNA, 42 bp, Artificial Sequence
  Description of Artificial Sequence: Synthetic oligonucleotide
tacgattattggggacagggtacattggtcaccgtctcctca

SEQ ID NO: 8523 - DNA, 42 bp, Artificial Sequence
  Description of Artificial Sequence: Synthetic oligonucleotide
ttcgatccctggggacagggtacattggtcaccgtctcctca

SEQ ID NO: 8524 - DNA, 42 bp, Artificial Sequence
  Description of Artificial Sequence: Synthetic oligonucleotide
atggatgtgtggggccagggaacaactgtcaccgtctcctca

SEQ ID NO: 8525 - DNA, 42 bp, Artificial Sequence
  Description of Artificial Sequence: Synthetic oligonucleotide
ttmcaacactggggacagggtacattggtcaccgtctcctca

SEQ ID NO: 8526 - DNA, 42 bp, Artificial Sequence
  Description of Artificial Sequence: Synthetic oligonucleotide
stagacgtatggggtcagggtacaatggtcaccgtctcctca

SEQ ID NO: 8527 - DNA, 42 bp, Artificial Sequence
  Description of Artificial Sequence: Synthetic oligonucleotide
ttmgacatatggggtcagggtacaatggtcaccgtctcctca

SEQ ID NO: 8528 - DNA, 42 bp, Artificial Sequence
  Description of Artificial Sequence: Synthetic oligonucleotide
ttmgacctatgggggagaggtaccttggtcaccgtctcctca

SEQ ID NO: 8529 - DNA, 42 bp, Artificial Sequence
  Description of Artificial Sequence: Synthetic oligonucleotide
tyagacccatggggacagggtacattggtcaccgtctcctca

SEQ ID NO: 8530 - DNA, 45 bp, Artificial Sequence
  Description of Artificial Sequence: Synthetic oligonucleotide
gcctttgatatttggggtcagggtacaatggtcaccgtctcctca

SEQ ID NO: 8531 - DNA, 45 bp, Artificial Sequence
  Description of Artificial Sequence: Synthetic oligonucleotide
tactttgactactggggacagggtacattggtcaccgtctcctca

SEQ ID NO: 8532 - DNA, 45 bp, Artificial Sequence
  Description of Artificial Sequence: Synthetic oligonucleotide
aatttcgactactggggacagggtacattggtcaccgtctcctca

SEQ ID NO: 8533 - DNA, 45 bp, Artificial Sequence
  Description of Artificial Sequence: Synthetic oligonucleotide
gacttcgactattggggacagggtacattggtcaccgtctcctca

SEQ ID NO: 8534 - DNA, 45 bp, Artificial Sequence
  Description of Artificial Sequence: Synthetic oligonucleotide
catttcgattactggggacagggtacattggtcaccgtctcctca

SEQ ID NO: 8535 - DNA, 45 bp, Artificial Sequence
  Description of Artificial Sequence: Synthetic oligonucleotide
ttctttgattattggggacagggtacattggtcaccgtctcctca

SEQ ID NO: 8536 - DNA, 45 bp, Artificial Sequence
  Description of Artificial Sequence: Synthetic oligonucleotide
tcttttgattattggggacagggtacattggtcaccgtctcctca

SEQ ID NO: 8537 - DNA, 45 bp, Artificial Sequence
  Description of Artificial Sequence: Synthetic oligonucleotide
agattcgactactggggacagggtacattggtcaccgtctcctca

SEQ ID NO: 8538 - DNA, 45 bp, Artificial Sequence
  Description of Artificial Sequence: Synthetic oligonucleotide
ttgttcgactactggggacagggtacattggtcaccgtctcctca

SEQ ID NO: 8539 - DNA, 45 bp, Artificial Sequence
  Description of Artificial Sequence: Synthetic oligonucleotide
cccttcgactattggggacagggtacattggtcaccgtctcctca

SEQ ID NO: 8540 - DNA, 45 bp, Artificial Sequence
  Description of Artificial Sequence: Synthetic oligonucleotide
attttcgattattggggacagggtacattggtcaccgtctcctca

SEQ ID NO: 8541 - DNA, 45 bp, Artificial Sequence
  Description of Artificial Sequence: Synthetic oligonucleotide
acctttgattactggggacagggtacattggtcaccgtctcctca

SEQ ID NO: 8542 - DNA, 45 bp, Artificial Sequence
  Description of Artificial Sequence: Synthetic oligonucleotide
ggattcgattactggggacagggtacattggtcaccgtctcctca

SEQ ID NO: 8543 - DNA, 45 bp, Artificial Sequence
  Description of Artificial Sequence: Synthetic oligonucleotide
gttttcgattactggggacagggtacattggtcaccgtctcctca

SEQ ID NO: 8544 - DNA, 45 bp, Artificial Sequence
  Description of Artificial Sequence: Synthetic oligonucleotide
gcttttgactactggggacagggtacattggtcaccgtctcctca

SEQ ID NO: 8545 - DNA, 45 bp, Artificial Sequence
  Description of Artificial Sequence: Synthetic oligonucleotide
tggtttgatccatggggacagggtacattggtcaccgtctcctca

SEQ ID NO: 8546 - DNA, 45 bp, Artificial Sequence
  Description of Artificial Sequence: Synthetic oligonucleotide
ggaatggacgtatggggccagggaacaactgtcaccgtctcctca

SEQ ID NO: 8547 - DNA, 45 bp, Artificial Sequence
  Description of Artificial Sequence: Synthetic oligonucleotide
ycaatggacgtatggggccagggaacaactgtcaccgtctcctca

SEQ ID NO: 8548 - DNA, 45 bp, Artificial Sequence
  Description of Artificial Sequence: Synthetic oligonucleotide
kacatggacgtatggggcaagggtacaactgtcaccgtctcctca

SEQ ID NO: 8549 - DNA, 45 bp, Artificial Sequence
  Description of Artificial Sequence: Synthetic oligonucleotide
stattcgacatatggggtcagggtacaatggtcaccgtctcctca

SEQ ID NO: 8550 - DNA, 45 bp, Artificial Sequence
  Description of Artificial Sequence: Synthetic oligonucleotide
kacttcgacctatgggggagaggtaccttggtcaccgtctcctca

SEQ ID NO: 8551 - DNA, 45 bp, Artificial Sequence
  Description of Artificial Sequence: Synthetic oligonucleotide
kacttccaacactggggacagggtacattggtcaccgtctcctca

SEQ ID NO: 8552 - DNA, 45 bp, Artificial Sequence
  Description of Artificial Sequence: Synthetic oligonucleotide
gsattcgacccatggggacagggtacattggtcaccgtctcctca

SEQ ID NO: 8553 - DNA, 45 bp, Artificial Sequence
  Description of Artificial Sequence: Synthetic oligonucleotide
ycattcgacatatggggtcagggtacaatggtcaccgtctcctca

SEQ ID NO: 8554 - DNA, 45 bp, Artificial Sequence
  Description of Artificial Sequence: Synthetic oligonucleotide
agmttcgacccatggggacagggtacattggtcaccgtctcctca

SEQ ID NO: 8555 - DNA, 48 bp, Artificial Sequence
  Description of Artificial Sequence: Synthetic oligonucleotide
tggtacttcgacttatgggggagaggtaccttggtcaccgtctcctca

SEQ ID NO: 8556 - DNA, 48 bp, Artificial Sequence
  Description of Artificial Sequence: Synthetic oligonucleotide
gacgcatttgatatatggggtcagggtacaatggtcaccgtctcctca

SEQ ID NO: 8557 - DNA, 48 bp, Artificial Sequence
  Description of Artificial Sequence: Synthetic oligonucleotide
tacgcatttgatatttggggtcagggtacaatggtcaccgtctcctca

SEQ ID NO: 8558 - DNA, 48 bp, Artificial Sequence
  Description of Artificial Sequence: Synthetic oligonucleotide
cacgcattcgacatctggggtcagggtacaatggtcaccgtctcctca

SEQ ID NO: 8559 - DNA, 48 bp, Artificial Sequence
  Description of Artificial Sequence: Synthetic oligonucleotide
ttcgcattcgatatctggggtcagggtacaatggtcaccgtctcctca

SEQ ID NO: 8560 - DNA, 48 bp, Artificial Sequence
  Description of Artificial Sequence: Synthetic oligonucleotide
tcagctttcgacatatggggtcagggtacaatggtcaccgtctcctca

SEQ ID NO: 8561 - DNA, 48 bp, Artificial Sequence
  Description of Artificial Sequence: Synthetic oligonucleotide
agagccttcgatatatggggtcagggtacaatggtcaccgtctcctca

SEQ ID NO: 8562 - DNA, 48 bp, Artificial Sequence
  Description of Artificial Sequence: Synthetic oligonucleotide
ttagccttcgatatctggggtcagggtacaatggtcaccgtctcctca

SEQ ID NO: 8563 - DNA, 48 bp, Artificial Sequence
  Description of Artificial Sequence: Synthetic oligonucleotide
ggagccttcgacatatggggtcagggtacaatggtcaccgtctcctca

SEQ ID NO: 8564 - DNA, 48 bp, Artificial Sequence
  Description of Artificial Sequence: Synthetic oligonucleotide
gactattttgattactggggacagggtacattggtcaccgtctcctca

SEQ ID NO: 8565 - DNA, 48 bp, Artificial Sequence
  Description of Artificial Sequence: Synthetic oligonucleotide
tattactttgattactggggacagggtacattggtcaccgtctcctca

SEQ ID NO: 8566 - DNA, 48 bp, Artificial Sequence
  Description of Artificial Sequence: Synthetic oligonucleotide
cactatttcgactattggggacagggtacattggtcaccgtctcctca

SEQ ID NO: 8567 - DNA, 48 bp, Artificial Sequence
  Description of Artificial Sequence: Synthetic oligonucleotide
ttctattttgattactggggacagggtacattggtcaccgtctcctca

SEQ ID NO: 8568 - DNA, 48 bp, Artificial Sequence
  Description of Artificial Sequence: Synthetic oligonucleotide
agttattttgactattggggacagggtacattggtcaccgtctcctca

SEQ ID NO: 8569 - DNA, 48 bp, Artificial Sequence
  Description of Artificial Sequence: Synthetic oligonucleotide
agatactttgattactggggacagggtacattggtcaccgtctcctca

SEQ ID NO: 8570 - DNA, 48 bp, Artificial Sequence
  Description of Artificial Sequence: Synthetic oligonucleotide
ttatatttcgactattggggacagggtacattggtcaccgtctcctca

SEQ ID NO: 8571 - DNA, 48 bp, Artificial Sequence
  Description of Artificial Sequence: Synthetic oligonucleotide
ccctactttgactattggggacagggtacattggtcaccgtctcctca

SEQ ID NO: 8572 - DNA, 48 bp, Artificial Sequence
  Description of Artificial Sequence: Synthetic oligonucleotide
ggatatttcgattattggggacagggtacattggtcaccgtctcctca

SEQ ID NO: 8573 - DNA, 48 bp, Artificial Sequence
  Description of Artificial Sequence: Synthetic oligonucleotide
gtttactttgattattggggacagggtacattggtcaccgtctcctca

SEQ ID NO: 8574 - DNA, 48 bp, Artificial Sequence
  Description of Artificial Sequence: Synthetic oligonucleotide
gcttactttgattattggggacagggtacattggtcaccgtctcctca

SEQ ID NO: 8575 - DNA, 48 bp, Artificial Sequence
  Description of Artificial Sequence: Synthetic oligonucleotide
aactacttcgattactggggacagggtacattggtcaccgtctcctca

SEQ ID NO: 8576 - DNA, 48 bp, Artificial Sequence
  Description of Artificial Sequence: Synthetic oligonucleotide
aattggttcgatccttggggacagggtacattggtcaccgtctcctca

SEQ ID NO: 8577 - DNA, 48 bp, Artificial Sequence
  Description of Artificial Sequence: Synthetic oligonucleotide
gattggtttgatccatggggacagggtacattggtcaccgtctcctca

SEQ ID NO: 8578 - DNA, 48 bp, Artificial Sequence
  Description of Artificial Sequence: Synthetic oligonucleotide
tattggtttgatccatggggacagggtacattggtcaccgtctcctca

SEQ ID NO: 8579 - DNA, 48 bp, Artificial Sequence
  Description of Artificial Sequence: Synthetic oligonucleotide
cactggttcgatccatggggacagggtacattggtcaccgtctcctca

SEQ ID NO: 8580 - DNA, 48 bp, Artificial Sequence
  Description of Artificial Sequence: Synthetic oligonucleotide
ttctggtttgacccctggggacagggtacattggtcaccgtctcctca

SEQ ID NO: 8581 - DNA, 48 bp, Artificial Sequence
  Description of Artificial Sequence: Synthetic oligonucleotide
tcttggtttgatccctggggacagggtacattggtcaccgtctcctca

SEQ ID NO: 8582 - DNA, 48 bp, Artificial Sequence
  Description of Artificial Sequence: Synthetic oligonucleotide
agatggtttgatccttggggacagggtacattggtcaccgtctcctca

SEQ ID NO: 8583 - DNA, 48 bp, Artificial Sequence
  Description of Artificial Sequence: Synthetic oligonucleotide
ggttggttcgatccctggggacagggtacattggtcaccgtctcctca

SEQ ID NO: 8584 - DNA, 48 bp, Artificial Sequence
  Description of Artificial Sequence: Synthetic oligonucleotide
gcttggtttgatccatggggacagggtacattggtcaccgtctcctca

SEQ ID NO: 8585 - DNA, 48 bp, Artificial Sequence
  Description of Artificial Sequence: Synthetic oligonucleotide
tacggtatggacgtttggggccagggaacaactgtcaccgtctcctca

SEQ ID NO: 8586 - DNA, 48 bp, Artificial Sequence
  Description of Artificial Sequence: Synthetic oligonucleotide
gatgggatggatgtttggggccagggaacaactgtcaccgtctcctca

SEQ ID NO: 8587 - DNA, 48 bp, Artificial Sequence
  Description of Artificial Sequence: Synthetic oligonucleotide
scagcattcgacatatggggtcagggtacaatggtcaccgtctcctca

SEQ ID NO: 8588 - DNA, 48 bp, Artificial Sequence
  Description of Artificial Sequence: Synthetic oligonucleotide
mcatggttcgacccatggggacagggtacattggtcaccgtctcctca

SEQ ID NO: 8589 - DNA, 48 bp, Artificial Sequence
  Description of Artificial Sequence: Synthetic oligonucleotide
rgctacttcgacctatgggggagaggtaccttggtcaccgtctcctca

SEQ ID NO: 8590 - DNA, 48 bp, Artificial Sequence
  Description of Artificial Sequence: Synthetic oligonucleotide
ayatacttcgactactggggacagggtacattggtcaccgtctcctca

SEQ ID NO: 8591 - DNA, 48 bp, Artificial Sequence
  Description of Artificial Sequence: Synthetic oligonucleotide
rtatggttcgacccatggggacagggtacattggtcaccgtctcctca

SEQ ID NO: 8592 - DNA, 48 bp, Artificial Sequence
  Description of Artificial Sequence: Synthetic oligonucleotide
cwcggaatggacgtatggggccagggaacaactgtcaccgtctcctca

SEQ ID NO: 8593 - DNA, 48 bp, Artificial Sequence
  Description of Artificial Sequence: Synthetic oligonucleotide
kcaggaatggacgtatggggccagggaacaactgtcaccgtctcctca

SEQ ID NO: 8594 - DNA, 48 bp, Artificial Sequence
  Description of Artificial Sequence: Synthetic oligonucleotide
rtagcattcgacatatggggtcagggtacaatggtcaccgtctcctca

SEQ ID NO: 8595 - DNA, 48 bp, Artificial Sequence
  Description of Artificial Sequence: Synthetic oligonucleotide
ragtacttccaacactggggacagggtacattggtcaccgtctcctca

SEQ ID NO: 8596 - DNA, 48 bp, Artificial Sequence
  Description of Artificial Sequence: Synthetic oligonucleotide
amcgcattcgacatatggggtcagggtacaatggtcaccgtctcctca

SEQ ID NO: 8597 - DNA, 48 bp, Artificial Sequence
  Description of Artificial Sequence: Synthetic oligonucleotide
ckatacttcgacctatgggggagaggtaccttggtcaccgtctcctca

SEQ ID NO: 8598 - DNA, 48 bp, Artificial Sequence
  Description of Artificial Sequence: Synthetic oligonucleotide
kactacatggacgtatggggcaagggtacaactgtcaccgtctcctca

SEQ ID NO: 8599 - DNA, 51 bp, Artificial Sequence
  Description of Artificial Sequence: Synthetic oligonucleotide
tactggtacttcgatttgtgggggagaggtaccttggtcaccgtctcctca

SEQ ID NO: 8600 - DNA, 51 bp, Artificial Sequence
  Description of Artificial Sequence: Synthetic oligonucleotide
gattggtacttcgatttatgggggagaggtaccttggtcaccgtctcctca

SEQ ID NO: 8601 - DNA, 51 bp, Artificial Sequence
  Description of Artificial Sequence: Synthetic oligonucleotide
gataattggttcgatccatggggacagggtacattggtcaccgtctcctca

SEQ ID NO: 8602 - DNA, 51 bp, Artificial Sequence
  Description of Artificial Sequence: Synthetic oligonucleotide
tataactggttcgatccctggggacagggtacattggtcaccgtctcctca

SEQ ID NO: 8603 - DNA, 51 bp, Artificial Sequence
  Description of Artificial Sequence: Synthetic oligonucleotide
cacaattggttcgacccctggggacagggtacattggtcaccgtctcctca

SEQ ID NO: 8604 - DNA, 51 bp, Artificial Sequence
  Description of Artificial Sequence: Synthetic oligonucleotide
ttcaattggtttgatccctggggacagggtacattggtcaccgtctcctca

SEQ ID NO: 8605 - DNA, 51 bp, Artificial Sequence
  Description of Artificial Sequence: Synthetic oligonucleotide
agcaactggttcgacccatggggacagggtacattggtcaccgtctcctca

SEQ ID NO: 8606 - DNA, 51 bp, Artificial Sequence
  Description of Artificial Sequence: Synthetic oligonucleotide
agaaactggtttgatccatggggacagggtacattggtcaccgtctcctca

SEQ ID NO: 8607 - DNA, 51 bp, Artificial Sequence
  Description of Artificial Sequence: Synthetic oligonucleotide
ttaaattggttcgacccttggggacagggtacattggtcaccgtctcctca

SEQ ID NO: 8608 - DNA, 51 bp, Artificial Sequence
  Description of Artificial Sequence: Synthetic oligonucleotide
cccaattggtttgatccatggggacagggtacattggtcaccgtctcctca

SEQ ID NO: 8609 - DNA, 51 bp, Artificial Sequence
  Description of Artificial Sequence: Synthetic oligonucleotide
ataaattggttcgacccttggggacagggtacattggtcaccgtctcctca

SEQ ID NO: 8610 - DNA, 51 bp, Artificial Sequence
  Description of Artificial Sequence: Synthetic oligonucleotide
actaactggtttgacccatggggacagggtacattggtcaccgtctcctca

SEQ ID NO: 8611 - DNA, 51 bp, Artificial Sequence
  Description of Artificial Sequence: Synthetic oligonucleotide
ggtaactggtttgacccatggggacagggtacattggtcaccgtctcctca

SEQ ID NO: 8612 - DNA, 51 bp, Artificial Sequence
  Description of Artificial Sequence: Synthetic oligonucleotide
gtgaactggtttgatccctggggacagggtacattggtcaccgtctcctca

SEQ ID NO: 8613 - DNA, 51 bp, Artificial Sequence
  Description of Artificial Sequence: Synthetic oligonucleotide
gccaactggttcgatccctggggacagggtacattggtcaccgtctcctca

SEQ ID NO: 8614 - DNA, 51 bp, Artificial Sequence
  Description of Artificial Sequence: Synthetic oligonucleotide
aacaattggttcgacccatggggacagggtacattggtcaccgtctcctca

SEQ ID NO: 8615 - DNA, 51 bp, Artificial Sequence
  Description of Artificial Sequence: Synthetic oligonucleotide
tactacggcatggatgtatggggccagggaacaactgtcaccgtctcctca

SEQ ID NO: 8616 - DNA, 51 bp, Artificial Sequence
  Description of Artificial Sequence: Synthetic oligonucleotide
gattatggaatggacgtatggggccagggaacaactgtcaccgtctcctca

SEQ ID NO: 8617 - DNA, 51 bp, Artificial Sequence
  Description of Artificial Sequence: Synthetic oligonucleotide
ttctacggtatggatgtctggggccagggaacaactgtcaccgtctcctca

SEQ ID NO: 8618 - DNA, 51 bp, Artificial Sequence
  Description of Artificial Sequence: Synthetic oligonucleotide
cattacggaatggacgtatggggccagggaacaactgtcaccgtctcctca

SEQ ID NO: 8619 - DNA, 51 bp, Artificial Sequence
  Description of Artificial Sequence: Synthetic oligonucleotide
ttgtacggaatggacgtttggggccagggaacaactgtcaccgtctcctca

SEQ ID NO: 8620 - DNA, 51 bp, Artificial Sequence
  Description of Artificial Sequence: Synthetic oligonucleotide
aactatggcatggatgtgtggggccagggaacaactgtcaccgtctcctca

SEQ ID NO: 8621 - DNA, 51 bp, Artificial Sequence
  Description of Artificial Sequence: Synthetic oligonucleotide
cwctggtacttcgacctatgggggagaggtaccttggtcaccgtctcctca

SEQ ID NO: 8622 - DNA, 51 bp, Artificial Sequence
  Description of Artificial Sequence: Synthetic oligonucleotide
scatacggaatggacgtatggggccagggaacaactgtcaccgtctcctca

SEQ ID NO: 8623 - DNA, 51 bp, Artificial Sequence
  Description of Artificial Sequence: Synthetic oligonucleotide
scagaatacttccaacactggggacagggtacattggtcaccgtctcctca

SEQ ID NO: 8624 - DNA, 51 bp, Artificial Sequence
  Description of Artificial Sequence: Synthetic oligonucleotide
kactactacatggacgtatggggcaagggtacaactgtcaccgtctcctca

SEQ ID NO: 8625 - DNA, 51 bp, Artificial Sequence
  Description of Artificial Sequence: Synthetic oligonucleotide
gkatacggaatggacgtatggggccagggaacaactgtcaccgtctcctca

SEQ ID NO: 8626 - DNA, 51 bp, Artificial Sequence
  Description of Artificial Sequence: Synthetic oligonucleotide
akctacggaatggacgtatggggccagggaacaactgtcaccgtctcctca

SEQ ID NO: 8627 - DNA, 51 bp, Artificial Sequence
  Description of Artificial Sequence: Synthetic oligonucleotide
arctggtacttcgacctatgggggagaggtaccttggtcaccgtctcctca

SEQ ID NO: 8628 - DNA, 51 bp, Artificial Sequence
  Description of Artificial Sequence: Synthetic oligonucleotide
asatacggaatggacgtatggggccagggaacaactgtcaccgtctcctca

SEQ ID NO: 8629 - DNA, 54 bp, Artificial Sequence
  Description of Artificial Sequence: Synthetic oligonucleotide
tattactatggtatggatgtatggggccagggaacaactgtcaccgtctcctca

SEQ ID NO: 8630 - DNA, 54 bp, Artificial Sequence
  Description of Artificial Sequence: Synthetic oligonucleotide
tattactattatatggatgtttggggcaagggtacaactgtcaccgtctcctca

SEQ ID NO: 8631 - DNA, 54 bp, Artificial Sequence
  Description of Artificial Sequence: Synthetic oligonucleotide
gattactacggcatggatgtttggggccagggaacaactgtcaccgtctcctca

SEQ ID NO: 8632 - DNA, 54 bp, Artificial Sequence
  Description of Artificial Sequence: Synthetic oligonucleotide
aactactacggcatggacgtatggggccagggaacaactgtcaccgtctcctca

SEQ ID NO: 8633 - DNA, 54 bp, Artificial Sequence
  Description of Artificial Sequence: Synthetic oligonucleotide
cwctactacggaatggacgtatggggccagggaacaactgtcaccgtctcctca

SEQ ID NO: 8634 - DNA, 54 bp, Artificial Sequence
  Description of Artificial Sequence: Synthetic oligonucleotide
ractactactacatggacgtatggggcaagggtacaactgtcaccgtctcctca

SEQ ID NO: 8635 - DNA, 54 bp, Artificial Sequence
  Description of Artificial Sequence: Synthetic oligonucleotide
ycatactacggaatggacgtatggggccagggaacaactgtcaccgtctcctca

SEQ ID NO: 8636 - DNA, 57 bp, Artificial Sequence
  Description of Artificial Sequence: Synthetic oligonucleotide
tattactactacggaatggacgtttggggccagggaacaactgtcaccgtctcctca

SEQ ID NO: 8637 - DNA, 57 bp, Artificial Sequence
  Description of Artificial Sequence: Synthetic oligonucleotide
aattattattacggcatggacgtctggggccagggaacaactgtcaccgtctcctca

SEQ ID NO: 8638 - DNA, 57 bp, Artificial Sequence
  Description of Artificial Sequence: Synthetic oligonucleotide
gattactattacggtatggatgtctggggccagggaacaactgtcaccgtctcctca

SEQ ID NO: 8639 - DNA, 57 bp, Artificial Sequence
  Description of Artificial Sequence: Synthetic oligonucleotide
cactattactacggcatggacgtatggggccagggaacaactgtcaccgtctcctca

SEQ ID NO: 8640 - DNA, 57 bp, Artificial Sequence
  Description of Artificial Sequence: Synthetic oligonucleotide
ttctattattatggtatggatgtttggggccagggaacaactgtcaccgtctcctca

SEQ ID NO: 8641 - DNA, 57 bp, Artificial Sequence
  Description of Artificial Sequence: Synthetic oligonucleotide
tcttactactatgggatggacgtgtggggccagggaacaactgtcaccgtctcctca

SEQ ID NO: 8642 - DNA, 57 bp, Artificial Sequence
  Description of Artificial Sequence: Synthetic oligonucleotide
agatattactacggcatggatgtttggggccagggaacaactgtcaccgtctcctca

SEQ ID NO: 8643 - DNA, 57 bp, Artificial Sequence
  Description of Artificial Sequence: Synthetic oligonucleotide
ttatactactatgggatggatgtatggggccagggaacaactgtcaccgtctcctca

SEQ ID NO: 8644 - DNA, 57 bp, Artificial Sequence
  Description of Artificial Sequence: Synthetic oligonucleotide
ccttactactatggcatggacgtctggggccagggaacaactgtcaccgtctcctca

SEQ ID NO: 8645 - DNA, 57 bp, Artificial Sequence
  Description of Artificial Sequence: Synthetic oligonucleotide
acctattactatggtatggatgtgtggggccagggaacaactgtcaccgtctcctca

SEQ ID NO: 8646 - DNA, 57 bp, Artificial Sequence
  Description of Artificial Sequence: Synthetic oligonucleotide
ggatactactatgggatggacgtctggggccagggaacaactgtcaccgtctcctca

SEQ ID NO: 8647 - DNA, 57 bp, Artificial Sequence
  Description of Artificial Sequence: Synthetic oligonucleotide
gcctactattatggcatggacgtctggggccagggaacaactgtcaccgtctcctca

SEQ ID NO: 8648 - DNA, 57 bp, Artificial Sequence
  Description of Artificial Sequence: Synthetic oligonucleotide
tactactattattatatggacgtttggggcaagggtacaactgtcaccgtctcctca

SEQ ID NO: 8649 - DNA, 57 bp, Artificial Sequence
  Description of Artificial Sequence: Synthetic oligonucleotide
aactactactactatatggatgtttggggcaagggtacaactgtcaccgtctcctca

SEQ ID NO: 8650 - DNA, 57 bp, Artificial Sequence
  Description of Artificial Sequence: Synthetic oligonucleotide
gattattattactatatggacgtctggggcaagggtacaactgtcaccgtctcctca

SEQ ID NO: 8651 - DNA, 57 bp, Artificial Sequence
  Description of Artificial Sequence: Synthetic oligonucleotide
rtatactactacggaatggacgtatggggccagggaacaactgtcaccgtctcctca

SEQ ID NO: 8652 - DNA, 57 bp, Artificial Sequence
  Description of Artificial Sequence: Synthetic oligonucleotide
rgctactactactacatggacgtatggggcaagggtacaactgtcaccgtctcctca

SEQ ID NO: 8653 - DNA, 57 bp, Artificial Sequence
  Description of Artificial Sequence: Synthetic oligonucleotide
cmctactactactacatggacgtatggggcaagggtacaactgtcaccgtctcctca

SEQ ID NO: 8654 - DNA, 60 bp, Artificial Sequence
  Description of Artificial Sequence: Synthetic oligonucleotide
tattactattattacgggatggacgtatggggccagggaacaactgtcaccgtctcctca

SEQ ID NO: 8655 - DNA, 60 bp, Artificial Sequence
  Description of Artificial Sequence: Synthetic oligonucleotide
aattattattattatgggatggacgtatggggccagggaacaactgtcaccgtctcctca

SEQ ID NO: 8656 - DNA, 60 bp, Artificial Sequence
  Description of Artificial Sequence: Synthetic oligonucleotide
gactattactattatggaatggatgtatggggccagggaacaactgtcaccgtctcctca

SEQ ID NO: 8657 - DNA, 60 bp, Artificial Sequence
  Description of Artificial Sequence: Synthetic oligonucleotide
cattattattattacggaatggacgtttggggccagggaacaactgtcaccgtctcctca

SEQ ID NO: 8658 - DNA, 60 bp, Artificial Sequence
  Description of Artificial Sequence: Synthetic oligonucleotide
ttctattactattatggcatggatgtgtggggccagggaacaactgtcaccgtctcctca

SEQ ID NO: 8659 - DNA, 60 bp, Artificial Sequence
  Description of Artificial Sequence: Synthetic oligonucleotide
agctactactattatggtatggacgtgtggggccagggaacaactgtcaccgtctcctca

SEQ ID NO: 8660 - DNA, 60 bp, Artificial Sequence
  Description of Artificial Sequence: Synthetic oligonucleotide
agatattactactatggcatggatgtctggggccagggaacaactgtcaccgtctcctca

SEQ ID NO: 8661 - DNA, 60 bp, Artificial Sequence
  Description of Artificial Sequence: Synthetic oligonucleotide
ttatactactattacggcatggatgtctggggccagggaacaactgtcaccgtctcctca

SEQ ID NO: 8662 - DNA, 60 bp, Artificial Sequence
  Description of Artificial Sequence: Synthetic oligonucleotide
ccctattattactacggaatggacgtttggggccagggaacaactgtcaccgtctcctca

SEQ ID NO: 8663 - DNA, 60 bp, Artificial Sequence
  Description of Artificial Sequence: Synthetic oligonucleotide
atctattactattatggcatggatgtatggggccagggaacaactgtcaccgtctcctca

SEQ ID NO: 8664 - DNA, 60 bp, Artificial Sequence
  Description of Artificial Sequence: Synthetic oligonucleotide
acctattactactatggcatggacgtttggggccagggaacaactgtcaccgtctcctca

SEQ ID NO: 8665 - DNA, 60 bp, Artificial Sequence
  Description of Artificial Sequence: Synthetic oligonucleotide
ggctactattactatgggatggacgtctggggccagggaacaactgtcaccgtctcctca

SEQ ID NO: 8666 - DNA, 60 bp, Artificial Sequence
  Description of Artificial Sequence: Synthetic oligonucleotide
gtctactattattatggcatggacgtatggggccagggaacaactgtcaccgtctcctca

SEQ ID NO: 8667 - DNA, 60 bp, Artificial Sequence
  Description of Artificial Sequence: Synthetic oligonucleotide
gcttactattactacggcatggacgtatggggccagggaacaactgtcaccgtctcctca

SEQ ID NO: 8668 - DNA, 63 bp, Artificial Sequence
  Description of Artificial Sequence: Synthetic oligonucleotide
gattattattattactatggtatggatgtgtggggccagggaacaactgtcaccgtctcctca

SEQ ID NO: 8669 - DNA, 63 bp, Artificial Sequence
  Description of Artificial Sequence: Synthetic oligonucleotide
tactattactactattatggcatggacgtctggggccagggaacaactgtcaccgtctcctca

SEQ ID NO: 8670 - DNA, 63 bp, Artificial Sequence
  Description of Artificial Sequence: Synthetic oligonucleotide
cactactactattattatgggatggacgtatggggccagggaacaactgtcaccgtctcctca

SEQ ID NO: 8671 - DNA, 63 bp, Artificial Sequence
  Description of Artificial Sequence: Synthetic oligonucleotide
ttctattattattattacggaatggacgtctggggccagggaacaactgtcaccgtctcctca

SEQ ID NO: 8672 - DNA, 63 bp, Artificial Sequence
  Description of Artificial Sequence: Synthetic oligonucleotide
agctactattactactatgggatggatgtgtggggccagggaacaactgtcaccgtctcctca

SEQ ID NO: 8673 - DNA, 63 bp, Artificial Sequence
  Description of Artificial Sequence: Synthetic oligonucleotide
agatattactattactatggtatggacgtttggggccagggaacaactgtcaccgtctcctca

SEQ ID NO: 8674 - DNA, 63 bp, Artificial Sequence
  Description of Artificial Sequence: Synthetic oligonucleotide
ttgtactattactattatggaatggacgtttggggccagggaacaactgtcaccgtctcctca

SEQ ID NO: 8675 - DNA, 63 bp, Artificial Sequence
  Description of Artificial Sequence: Synthetic oligonucleotide
ccttactattattattatgggatggatgtctggggccagggaacaactgtcaccgtctcctca

SEQ ID NO: 8676 - DNA, 63 bp, Artificial Sequence
  Description of Artificial Sequence: Synthetic oligonucleotide
atatattactattactacgggatggatgtttggggccagggaacaactgtcaccgtctcctca

SEQ ID NO: 8677 - DNA, 63 bp, Artificial Sequence
  Description of Artificial Sequence: Synthetic oligonucleotide
acctactattattattacgggatggacgtttggggccagggaacaactgtcaccgtctcctca

SEQ ID NO: 8678 - DNA, 63 bp, Artificial Sequence
  Description of Artificial Sequence: Synthetic oligonucleotide
ggttactattattactacgggatggacgtgtggggccagggaacaactgtcaccgtctcctca

SEQ ID NO: 8679 - DNA, 63 bp, Artificial Sequence
  Description of Artificial Sequence: Synthetic oligonucleotide
gtgtattactattactacgggatggacgtgtggggccagggaacaactgtcaccgtctcctca

SEQ ID NO: 8680 - DNA, 63 bp, Artificial Sequence
  Description of Artificial Sequence: Synthetic oligonucleotide
gcctattactactactatgggatggatgtgtggggccagggaacaactgtcaccgtctcctca

SEQ ID NO: 8681 - DNA, 63 bp, Artificial Sequence
  Description of Artificial Sequence: Synthetic oligonucleotide
aattattattactattacggtatggacgtgtggggccagggaacaactgtcaccgtctcctca

SEQ ID NO: 8682 - DNA, 63 bp, Artificial Sequence
  Description of Artificial Sequence: Synthetic oligonucleotide
kactactactactactactacatggacgtatggggcaagggtacaactgtcaccgtctcctca

SEQ ID NO: 8683 - protein, 4 aa, Artificial Sequence
  Description of Artificial Sequence: Synthetic peptide
DMDV

SEQ ID NO: 8684 - protein, 4 aa, Artificial Sequence
  Description of Artificial Sequence: Synthetic peptide
PMDV

SEQ ID NO: 8685 - protein, 4 aa, Artificial Sequence
  Description of Artificial Sequence: Synthetic peptide
SMDV

SEQ ID NO: 8686 - protein, 5 aa, Artificial Sequence
  Description of Artificial Sequence: Synthetic peptide
DGMDV

SEQ ID NO: 8687 - protein, 5 aa, Artificial Sequence
  Description of Artificial Sequence: Synthetic peptide
SYFDL

SEQ ID NO: 8688 - protein, 5 aa, Artificial Sequence
  Description of Artificial Sequence: Synthetic peptide
LYFDL

SEQ ID NO: 8689 - protein, 5 aa, Artificial Sequence
  Description of Artificial Sequence: Synthetic peptide
DYMDV

SEQ ID NO: 8690 - protein, 5 aa, Artificial Sequence
  Description of Artificial Sequence: Synthetic peptide
HGMDV

SEQ ID NO: 8691 - protein, 5 aa, Artificial Sequence
  Description of Artificial Sequence: Synthetic peptide
LGMDV

SEQ ID NO: 8692 - protein, 5 aa, Artificial Sequence
  Description of Artificial Sequence: Synthetic peptide
SGMDV

SEQ ID NO: 8693 - protein, 5 aa, Artificial Sequence
  Description of Artificial Sequence: Synthetic peptide
AGMDV

SEQ ID NO: 8694 - protein, 6 aa, Artificial Sequence
  Description of Artificial Sequence: Synthetic peptide
DYGMDV

SEQ ID NO: 8695 - protein, 6 aa, Artificial Sequence
  Description of Artificial Sequence: Synthetic peptide
FYGMDV

SEQ ID NO: 8696 - protein, 6 aa, Artificial Sequence
  Description of Artificial Sequence: Synthetic peptide
HYGMDV

SEQ ID NO: 8697 - protein, 6 aa, Artificial Sequence
  Description of Artificial Sequence: Synthetic peptide
LYGMDV

SEQ ID NO: 8698 - protein, 6 aa, Artificial Sequence
  Description of Artificial Sequence: Synthetic peptide
NYGMDV

SEQ ID NO: 8699 - protein, 6 aa, Artificial Sequence
  Description of Artificial Sequence: Synthetic peptide
LWYFDL

SEQ ID NO: 8700 - protein, 6 aa, Artificial Sequence
  Description of Artificial Sequence: Synthetic peptide
SWYFDL

SEQ ID NO: 8701 - protein, 6 aa, Artificial Sequence
  Description of Artificial Sequence: Synthetic peptide
DYYMDV

SEQ ID NO: 8702 - protein, 6 aa, Artificial Sequence
  Description of Artificial Sequence: Synthetic peptide
AYGMDV

SEQ ID NO: 8703 - protein, 6 aa, Artificial Sequence
  Description of Artificial Sequence: Synthetic peptide
PYGMDV

SEQ ID NO: 8704 - protein, 6 aa, Artificial Sequence
  Description of Artificial Sequence: Synthetic peptide
SYGMDV

SEQ ID NO: 8705 - protein, 6 aa, Artificial Sequence
  Description of Artificial Sequence: Synthetic peptide
IYGMDV

SEQ ID NO: 8706 - protein, 6 aa, Artificial Sequence
  Description of Artificial Sequence: Synthetic peptide
TYGMDV

SEQ ID NO: 8707 - protein, 6 aa, Artificial Sequence
  Description of Artificial Sequence: Synthetic peptide
RYGMDV

SEQ ID NO: 8708 - protein, 6 aa, Artificial Sequence
  Description of Artificial Sequence: Synthetic peptide
GYGMDV

SEQ ID NO: 8709 - protein, 6 aa, Artificial Sequence
  Description of Artificial Sequence: Synthetic peptide
VYGMDV

SEQ ID NO: 8710 - protein, 7 aa, Artificial Sequence
  Description of Artificial Sequence: Synthetic peptide
DYYGMDV

SEQ ID NO: 8711 - protein, 7 aa, Artificial Sequence
  Description of Artificial Sequence: Synthetic peptide
NYYGMDV

SEQ ID NO: 8712 - protein, 7 aa, Artificial Sequence
  Description of Artificial Sequence: Synthetic peptide
LYYGMDV

SEQ ID NO: 8713 - protein, 7 aa, Artificial Sequence
  Description of Artificial Sequence: Synthetic peptide
HYYGMDV

SEQ ID NO: 8714 - protein, 7 aa, Artificial Sequence
  Description of Artificial Sequence: Synthetic peptide
SYYGMDV

SEQ ID NO: 8715 - protein, 7 aa, Artificial Sequence
  Description of Artificial Sequence: Synthetic peptide
PYYGMDV

SEQ ID NO: 8716 - protein, 7 aa, Artificial Sequence
  Description of Artificial Sequence: Synthetic peptide
NYYYMDV

SEQ ID NO: 8717 - protein, 7 aa, Artificial Sequence
  Description of Artificial Sequence: Synthetic peptide
DYYYMDV

SEQ ID NO: 8718 - protein, 4 aa, Artificial Sequence
  Description of Artificial Sequence: Synthetic peptide
ERTI

SEQ ID NO: 8719 - protein, 10 aa, Artificial Sequence
  Description of Artificial Sequence: Synthetic peptide
DRYSGYDLGY

SEQ ID NO: 8720 - protein, 12 aa, Artificial Sequence
  Description of Artificial Sequence: Synthetic peptide
GIAAADSNWFDP

SEQ ID NO: 8721 - protein, 20 aa, Artificial Sequence
  Description of Artificial Sequence: Synthetic peptide
DEHLQVDEHLQVSYSTPFYT

SEQ ID NO: 8722 - protein, 25 aa, Artificial Sequence
  Description of Artificial Sequence: Synthetic peptide
DEHLQVQAEGIKLPQRTVYSTPFYT

SEQ ID NO: 8723 - protein, 23 aa, Artificial Sequence
  Description of Artificial Sequence: Synthetic peptide
DEHLQVQSADFHLPSVYSTPFYT

SEQ ID NO: 8724 - protein, 26 aa, Artificial Sequence
  Description of Artificial Sequence: Synthetic peptide
DEHLQVQSYADFHILNPSTVYTPFYT

SEQ ID NO: 8725 - protein, 23 aa, Artificial Sequence
  Description of Artificial Sequence: Synthetic peptide
DEHLQVQSYSADFHLPSVYPFYT

SEQ ID NO: 8726 - protein, 25 aa, Artificial Sequence
  Description of Artificial Sequence: Synthetic peptide
QDEHLQVAEGIKLPQRTVYSTPFYT

SEQ ID NO: 8727 - protein, 23 aa, Artificial Sequence
  Description of Artificial Sequence: Synthetic peptide
QDEHLQVSADFHLPSVYSTPFYT

SEQ ID NO: 8728 - protein, 26 aa, Artificial Sequence
  Description of Artificial Sequence: Synthetic peptide
QDEHLQVSYADFHILNPSTVYTPFYT

SEQ ID NO: 8729 - protein, 23 aa, Artificial Sequence
  Description of Artificial Sequence: Synthetic peptide
QDEHLQVSYSADFHLPSVYPFYT

SEQ ID NO: 8730 - protein, 28 aa, Artificial Sequence
  Description of Artificial Sequence: Synthetic peptide
QQAEGIKLPQRTVADFHLPSVYSTPFYT

SEQ ID NO: 8731 - protein, 31 aa, Artificial Sequence
  Description of Artificial Sequence: Synthetic polypeptide
QQAEGIKLPQRTVYADFHILNPSTVYTPFYT

SEQ ID NO: 8732 - protein, 28 aa, Artificial Sequence
  Description of Artificial Sequence: Synthetic peptide
QQAEGIKLPQRTVYSADFHLPSVYPFYT

SEQ ID NO: 8733 - protein, 29 aa, Artificial Sequence
  Description of Artificial Sequence: Synthetic peptide
QQSADFHLPSVYADFHILNPSTVYTPFYT

SEQ ID NO: 8734 - protein, 26 aa, Artificial Sequence
  Description of Artificial Sequence: Synthetic peptide
QQSADFHLPSVYSADFHLPSVYPFYT

SEQ ID NO: 8735 - protein, 29 aa, Artificial Sequence
  Description of Artificial Sequence: Synthetic peptide
QQSYADFHILNPSTVYADFHLPSVYPFYT

SEQ ID NO: 8736 - protein, 28 aa, Artificial Sequence
  Description of Artificial Sequence: Synthetic peptide
QQAEGIKLPQRTVADFHLPSVYSTPFYT

SEQ ID NO: 8737 - protein, 31 aa, Artificial Sequence; identical to SEQ ID NO: 8731
  Description of Artificial Sequence: Synthetic polypeptide

SEQ ID NO: 8738 - protein, 28 aa, Artificial Sequence
  Description of Artificial Sequence: Synthetic peptide
QQAEGIKLPQRTVYSADFHLPSVYPFYT

SEQ ID NO: 8739 - protein, 29 aa, Artificial Sequence
  Description of Artificial Sequence: Synthetic peptide
QQSADFHLPSVYADFHILNPSTVYTPFYT

SEQ ID NO: 8740 - protein, 26 aa, Artificial Sequence
  Description of Artificial Sequence: Synthetic peptide
QQSADFHLPSVYSADFHLPSVYPFYT

SEQ ID NO: 8741 - protein, 29 aa, Artificial Sequence
  Description of Artificial Sequence: Synthetic peptide
QQSYADFHILNPSTVYADFHLPSVYPFYT

SEQ ID NO: 8742 - protein, 39 aa, Artificial Sequence
  Description of Artificial Sequence: Synthetic polypeptide
QQAEGIKLPQRTVADFHLPSVYADFHILNPSTVYTPFYT

SEQ ID NO: 8743 - protein, 36 aa, Artificial Sequence
  Description of Artificial Sequence: Synthetic polypeptide
QQAEGIKLPQRTVADFHLPSVYSADFHLPSVYPFYT

SEQ ID NO: 8744 - protein, 39 aa, Artificial Sequence
  Description of Artificial Sequence: Synthetic polypeptide
QQAEGIKLPQRTVYADFHILNPSTVYADFHLPSVYPFYT

SEQ ID NO: 8745 - protein, 37 aa, Artificial Sequence
  Description of Artificial Sequence: Synthetic polypeptide
QQSADFHLPSVYADFHILNPSTVYADFHLPSVYPFYT

SEQ ID NO: 8746 - protein, 5 aa, Artificial Sequence
  Description of Artificial Sequence: Synthetic peptide
LVIIT

SEQ ID NO: 8747 - protein, 5 aa, Artificial Sequence
  Description of Artificial Sequence: Synthetic peptide
WCMLY

SEQ ID NO: 8748 - DNA, 15 bp, Artificial Sequence
  Description of Artificial Sequence: Synthetic oligonucleotide
atgcttttgatatct

SEQ ID NO: 8749 - DNA, 16 bp, Artificial Sequence
  Description of Artificial Sequence: Synthetic oligonucleotide
  modified_base (1)..(2): a, c, t or g
  misc_feature (1)..(2): n is a, c, g, or t
nntgcttttgatatct

SEQ ID NO: 8750 - DNA, 13 bp, Artificial Sequence
  Description of Artificial Sequence: Synthetic oligonucleotide
gcttttgatatct

SEQ ID NO: 8751 - DNA, 13 bp, Artificial Sequence
  Description of Artificial Sequence: Synthetic oligonucleotide
  modified_base (1)..(2): a, c, t or g
  misc_feature (1)..(2): n is a, c, g, or t
nnttttgatatct

SEQ ID NO: 8752 - DNA, 15 bp, Artificial Sequence
  Description of Artificial Sequence: Synthetic oligonucleotide
gctgaatacttccag

SEQ ID NO: 8753 - DNA, 15 bp, Artificial Sequence
  Description of Artificial Sequence: Synthetic oligonucleotide
  modified_base (1)..(2): a, c, t or g
  misc_feature (1)..(2): n is a, c, g, or t
nntgaatacttccag

SEQ ID NO: 8754 - DNA, 12 bp, Artificial Sequence
  Description of Artificial Sequence: Synthetic oligonucleotide
gaatacttccag

SEQ ID NO: 8755 - DNA, 12 bp, Artificial Sequence
  Description of Artificial Sequence: Synthetic oligonucleotide
  modified_base (1)..(2): a, c, t or g
  misc_feature (1)..(2): n is a, c, g, or t
nnatacttccag

SEQ ID NO: 8756 - DNA, 15 bp, Artificial Sequence
  Description of Artificial Sequence: Synthetic oligonucleotide
ctactggtacttcga

SEQ ID NO: 8757 - DNA, 15 bp, Artificial Sequence
  Description of Artificial Sequence: Synthetic oligonucleotide
  modified_base (1)..(2): a, c, t or g
  misc_feature (1)..(2): n is a, c, g, or t
nnactggtacttcga

SEQ ID NO: 8758 - DNA, 12 bp, Artificial Sequence
  Description of Artificial Sequence: Synthetic oligonucleotide
ctggtacttcga

SEQ ID NO: 8759 - DNA, 12 bp, Artificial Sequence
  Description of Artificial Sequence: Synthetic oligonucleotide
  modified_base (1)..(2): a, c, t or g
  misc_feature (1)..(2): n is a, c, g, or t
nnggtacttcga

SEQ ID NO: 8760 - protein, 16 aa, Artificial Sequence
  Description of Artificial Sequence: Synthetic peptide
ERTINWGWGGVYAFDI

SEQ ID NO: 8761 - protein, 15 aa, Artificial Sequence
  Description of Artificial Sequence: Synthetic peptide
ERTINWGWGWYAFDI

SEQ ID NO: 8762 - protein, 4 aa, Artificial Sequence
  chemically synthesized polypeptide
WGQG

SEQ ID NO: 8763 - protein, 4 aa, Artificial Sequence
  chemically synthesized polypeptide
WGRG

SEQ ID NO: 8764 - protein, 4 aa, Artificial Sequence
  chemically synthesized polypeptide
WGKG

What is claimed is:

1. A library comprising synthetic polynucleotides that encode an antibody heavy chain or alternative scaffold containing at least about $10^4$ unique antibody CDRH3 amino acid sequences, wherein each of the polynucleotides encoding the at least about $10^4$ unique antibody CDRH3 amino acid sequences has an antibody CDRH3 amino acid sequence represented by the following formula:

[TN1]-[DH]-[N2]- [H3-JH], wherein:

TN1 is a polypeptide corresponding to any of the TN1 polypeptides of Tables 10 and 18-26, or a polypeptide produced by translation of any of the TN1 polynucleotides of Tables 25-26;

DH is a polypeptide corresponding to any of the DH polypeptides of Tables 11, 17-25 and 28, or a polypeptide produced by translation of any of the DH-encoding polynucleotides of Tables 16, 25 and 27;

N2 is a polypeptide corresponding to any of the N2 polypeptides of Tables 12, 18-25 and 30, or a polypeptide produced by translation of any of the N2-encoding polynucleotides of Tables 25 and 29;

H3-JH is a polypeptide corresponding to any of the H3-JH polypeptides of Tables 13, 15, 18-25 and 32, or a polypeptide produced by translation of any of the H3-JH-encoding polynucleotides of Tables 14, 25 and 31;

wherein the diversity of the polynucleotides encoding the at least about $10^4$ unique antibody CDRH3 amino acid sequences is created by each of the polynucleotides having a CDRH3 sequence that is different from the CDRH3 sequence of every other polynucleotide;

wherein the antibody heavy chain is a variable domain with framework (FRM) and complementary determining regions (CDR) comprising FRMH1-CDRH1-FRMH2-CDRH2-FRMH3-CDRH3-FRMH4; and wherein the alternative scaffold is selected from the group consisting of fibronectin, the β-sandwich, lipocalin, EETI-IFAGRP, BPTIFLAC1-D1/IT1-D2, thioredoxin, protein A, ankyrin repeats, γB-crystallin/ubiquitin, $CTLD_3$ and $(LDLR-A module)_3$.

2. The library of claim 1, wherein the polynucleotides encode CDRH3 polypeptides produced by the sets of TN1, DH, N2, and H3-JH polypeptides provided in any one of Tables 23-25.

3. The library of claim 1, wherein the polynucleotides encode CDRI-13 polypeptides produced by the set of TN1 polypeptides provided in Table 26, the set of DH polypeptides provided in Table 28, the set of N2 polypeptides provided in Table 30 and the set of H3-JH polypeptides provided in Table 32.

4. The library of claim 1 wherein number of N-linked glycosylation sites, deamidation motifs, and/or Cys residues are reduced or eliminated in comparison to libraries produced by amplification of a repertoire from a biological source.

5. The library of claim 1, further comprising a polynucleotide encoding one or more light chain variable domain polypeptides.

6. The library of claim 5, wherein the polypeptides are expressed as full-length IgGs.

7. The polypeptide expression products of the library of claim 6.

8. An antibody isolated from the polypeptide expression products of claim 7.

9. A vector containing the library of claim 1.

10. A host cell containing the vector of claim 9.

11. The host cell of claim 10, wherein the host cell is a yeast cell.

12. The yeast cell of claim 11, wherein the yeast is *Saccharomyces cerevisiae*.

13. A kit containing the library of claim 1.

* * * * *